United States Patent
Brucher et al.

(10) Patent No.: US 11,142,749 B2
(45) Date of Patent: Oct. 12, 2021

(54) TREHALOSE PHOSPHORYLASE

(71) Applicants: c-Lecta GmbH, Leipzig (DE); New Matterhorn, LLC, Wilmington, DE (US)

(72) Inventors: Birgit Brucher, Leipzig (DE); Andreas Vogel, Leipzig (DE)

(73) Assignees: NEW MATTERHORN, LLC, Wilmington, DE (US); c-LEcta GmbH, Leipzig (DE)

(*) Notice: Subject to any disclaimer, the term of this patent is extended or adjusted under 35 U.S.C. 154(b) by 0 days.

(21) Appl. No.: 16/335,987

(22) PCT Filed: Nov. 28, 2017

(86) PCT No.: PCT/EP2017/080650
§ 371 (c)(1),
(2) Date: Mar. 22, 2019

(87) PCT Pub. No.: WO2018/096169
PCT Pub. Date: May 31, 2018

(65) Prior Publication Data
US 2019/0276808 A1    Sep. 12, 2019

(30) Foreign Application Priority Data
Nov. 28, 2016    (EP) ..................................... 16002528

(51) Int. Cl.
*C12N 9/10*     (2006.01)
*C12P 19/12*    (2006.01)

(52) U.S. Cl.
CPC ............ *C12N 9/1051* (2013.01); *C12P 19/12* (2013.01); *C12Y 204/01231* (2013.01)

(58) Field of Classification Search
None
See application file for complete search history.

(56) References Cited

U.S. PATENT DOCUMENTS

| | | |
|---|---|---|
| 5,798,234 A | 8/1998 | Engel et al. |
| 2013/0029384 A1 | 1/2013 | Cerdobbel et al. |

FOREIGN PATENT DOCUMENTS

| | | |
|---|---|---|
| EP | 0673999 A2 | 9/1995 |
| EP | 0976826 A1 | 2/2000 |
| WO | WO-9511296 A1 | 4/1995 |
| WO | WO-2012080100 A1 | 6/2012 |

OTHER PUBLICATIONS

Database UniProt [Online], 2010, SubName: Full-Glycosyltransferase family 4 protein {EC0: 0000313: EMBL: EFJ00254.1}, XP002767750, retrieved from EBI accession No. UNIPROT:D8PWQ7 Database accession No. D8PWQ7 cited in the application the whole document.

Databased UniProt [Online] 2016, SubName: Full-Trehalose phosphorylase {EC0:0000313: EMBL: KYQ39707.1}, XP002767751, retrieved from EBI accession No. UNIPROT: A0A151VW19 Database accession No. A0A151VW19 the whole document.

Schwarz, et al., Trehalose phosphorylase from Pleurotus ostreatus: Characterization and stabilization by covalent modification, and application for the synthesis of [alpha], [alpha]-trehalose, Journal of Biotechnology, 2007, 129(1):140-150.

Goedl, et al., Structure-function relationships for Schizophyllum commune trehalose phosphorylase and their implications for the catalytic mechanism of family GT-4 glycosyltransferases, Biochemical Journal, 2006, 397(3):491-500.

Database UniProt [Online] 2011, RecName: Full=trehalose phosphorylase {ECO:0000250: UniProtKB: Q9UV63} EC=2.4.1. 231; AltName: Full=Trehalose synthase {EC0:0000312: EMBL:BAA31350.1}; Short=TSase [EC0:0000303; PubMed: 9797287}; Flags: Precursor; XP002777188, retrieved from EBI accession No. UNIPROT:075003 Database accession No. 075003 sequence.

Database UniProt [Online] 2013, SubName: Full=Glycosyltransferase family 4 protein {EC0:0000313: EMBL: EMD34497.1}. XP002777189, retrieved from EBI accession No. UNIPROT:M2R7V9 Database accession No. M2R7V9 sequence.

Database UnitProt [Online] 2013, SubName: Full=Glycosyltransferase family 4 protein {EC0:0000313: EMBL:EKM55927.1; XP002778892, retrieved from EBI accession No. UNIPROT:K5WZK1 Database accession No. K5WZK1 sequence.

International Search Report issued in PCT/EP2017/080650 dated Mar. 23, 2018.

Han et al., Cloning and characterization of a gene encoding trehalose phosphorylase (TP) from Pleurotus sajor-caju. Protein Expr Purif. Aug. 2003;30(2):194-202.

Klimacek et al, Continuous production of α,α-trehalose by immobilised fungal trehalose phosphorylase Biotechnol. Technol. Apr. 1999;13(4): 243-248.

Eis et al., Characterization of trehalose phosphorylase from Schizophyllum commune. Biochem J. Jul. 1999;341 ( Pt 2):385-393.

Saito et al., Production of trehalose synthase from a basidiomycete, Grifola frondosa, in *Escherichia coli* Appl Microbiol Biotechnol. Aug. 1998; 50 (2): 193-198.

(Continued)

*Primary Examiner* — Kagnew H Gebreyesus
(74) *Attorney, Agent, or Firm* — Blank Rome LLP

(57) ABSTRACT

The present invention is related to a trehalose phosphorylase comprising an amino acid sequence, wherein the amino acid sequence of the trehalose phosphorylase is at least 80% identical to and/or at least 80% homologous to an amino acid sequence of SEQ ID NO: 1, wherein the amino acid sequence of the trehalose phosphorylase comprises an amino acid substitution at one or more amino acid positions, wherein the one or more amino acid positions is/are selected from the group consisting of amino acid positions of SEQ ID NO: 1 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705.

23 Claims, 6 Drawing Sheets

Figure 1:
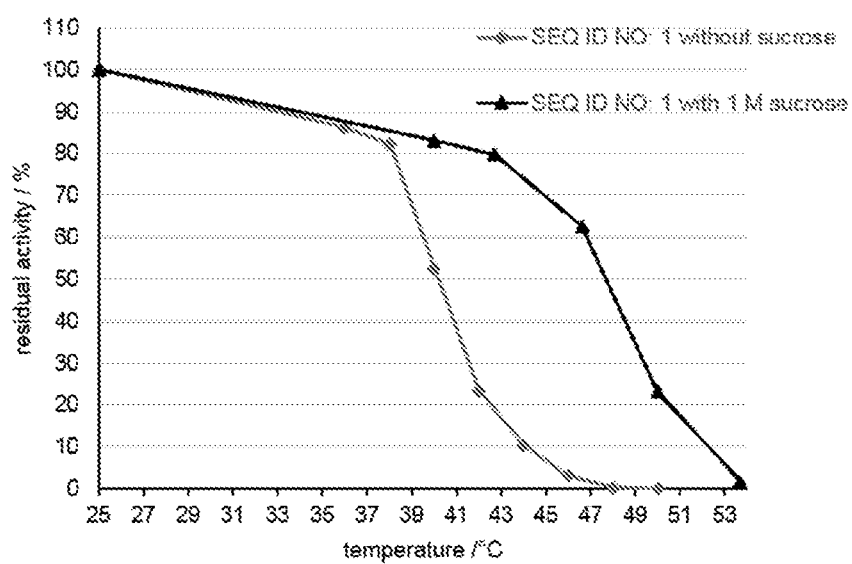

Specification includes a Sequence Listing.

(56) References Cited

OTHER PUBLICATIONS

Saito et al. Purification and characterization of a trehalose synthase from the basidiomycete grifola frondosa Appl.Environ.Microbiol. Nov. 1998,64(11): 4340-4345.

S. Lutz, U.T. Bornscheuer, Protein Engineering Handbook, Wiley VCH, Weinheim, 2009.

Goedl et al., The phosphate site of trehalose phosphorylase from Schizophyllum commune probed by site-directed mutagenesis and chemical rescue studies FEBS J. Mar. 2008;275(5):903-13.

Eis et al, The stereochemical course of the reaction mechanism of trehalose phosphorylase from Schizophyllum commune. FEBS Lett. Dec. 1998;440(3):440-3.

Altschul et al, Gapped BLAST and PSI-BLAST: a new generation of protein database search programs. Nucleic Acids Res. Sep. 1, 1997;25(17):3389-3402.

Altschul et al, Protein database searches using compositionally adjusted substitution matrices. FEBS J. Oct. 2005;272(20):5101-5109.

Lombard et al, The carbohydrate-active enzymes database (CAZy) in 2013. Nucleic Acids Res. Jan. 2014;42 (Database issue): D490-5 Accessible from: <URL:http://www.cazy.org/>.

Nidetzky et al, Alpha-retaining glucosyl transfer catalysed by trehalose phosphorylase from Schizophyllum commune: mechanistic evidence obtained from steady-state kinetic studies with substrate analogues and inhibitors. Biochem J. Dec. 2001;360(Pt 3):727-36.

Goujon et al, A new bioinformatics analysis tools framework at EMBL-EBI. Nucleic Acids Res. Jul. 2010;38(Web Server issue):W695-W699.

Genbank: ADM15725.1—wild type, Grifola frondosa ; Our reference: SEQ ID No. 81.

Genbank: KJA27491.1—wild type, Hypholoma sublateritium FD-334 SS-4, Our reference: SEQ ID No. 80.

Genbank: KDQ33172.1—wild type, Pleurotus ostreatus ; Our reference: SEQ ID No. 82.

UniProtKB/Swiss-Prot: Q9UV63.1—wild type, Lentinus sajor-caju ; Our reference: SEQ ID No. 83.

GenBank: ABC84380.1—Schizophyllum commune ; Our reference: SEQ ID No. 1.

Genbank: CD074881.1—Trametes cinnabarina ; Our reference: SEQ ID No. 192.

NCBI Reference: XP_008036133.1—Trametes versicolor FP-101664 SS1; Our reference: SEQ ID No. 194.

UniProtKB/Swiss-Prot: A6YRN9.1—Pleurotus pulmonarius ; Our reference: SEQ ID No. 195.

NCBI Reference Sequence: XP_006458503.1—*Agaricus bisporus* var. bisporus H97 ; Our reference: SEQ ID No. 196.

NCBI Reference Sequence: XP_007326883.1—*Agaricus bisporus* var. burnettii JB137-S8 ; Our reference: SEQ ID No. 197.

Genbank: KZT11205.1—Laetiporus sulphureus 93-53—SEQ ID No. 198.

NCBI Reference Sequence: XP_007863746.1—Gloeophyllum trabeum ATCC 11539 ; Our reference: SEQ ID No. 199.

Genbank: OBZ75413.1—Grifola frondosa ; Our reference: SEQ ID No. 200.

Genbank: OJT04097.1—Trametes pubescens ; Our reference: SEQ ID No. 201.

Kuo, et al., Database UniProt [Online] Apr. 29, 2015 (Apr. 29, 2015), "SubName: Full=Unplaced genomic scaffold scaffold_68, whole genome shotgun sequence {ECO:0000313IEMBL:KIK21380.1};", XP055708946, retrieved from EBI accession No. UNIPROT:A0A0C9Y9L5 Database accession No. A0A0C9Y9L5.

GenBank: ESK96889.1. Trehalose synthase [Moniliophthora roreri MCA 2997]. Oct. 30, 2013 Whole document. Citation is not enclosed due to copyright restrictions. A copy may be obtained from the URL at <https://www.ncbi.nlm.nih.goy/proteiniesk96889.1>.

FIGURE 3

```
SEQ_ID_NO:1                 -MSPPHGFSSVVPSTAARRRLLSSKASLTNRPTFKITTQTYASLTPMWAGIAGAPINNGSQ    59
KJA27491.1_H_sublateritium  ------------------------------------------MWAAVAGAVINNNTQ    15
ADM15725.1_G_frondosa       -MAPPHQFQSKPSDVIRRRLSSAVSSKR-PN-----VPGYTSLTPMWAGIAGAVVNNNSQ    53
KDQ33172.1_P_ostreatus      -MSTHHQFESKPSTAIRRRLSSSVSSKQRPN---M-TTTFASLTPMWAGVAGTLVNNNTQ    55
Q9UV63.1_L_sajor-caju       MSTPHHQFESKSSTAIRRRLSSSVSSKQRPN---IMTTTFASLTPMWAGVAGTLVNNNTQ    57
                                                                        ***.;**: :**.;*

SEQ_ID_NO:1                 FELAISVHDSVYSTDFASFVIDHTPLDPEKAAKEIEKHVLDALRKFSQEHLCKFLGAGIT   119
KJA27491.1_H_sublateritium  YEIAVSIHDSVYSTDFASSVLSFNPNNPDKNAKEIEQYVLQTLRMFSVGHLCKFLGAGVT    75
ADM15725.1_G_frondosa       FEVAISIHDSVYNTDFASSIVPYSPNEPEAQAGIIEKHVLETLRKFSTEHMCKFLGAGVT   113
KDQ33172.1_P_ostreatus      YEIAVTVHDGVYSTDFASVIIPVTPGDTAKNSKDIEAQVLMLIRKFSAEHLCKFLGAGIT   115
Q9UV63.1_L_sajor-caju       YEIAVTVHDGVYSTDFASVIIPVTPGDTVKNSKDIEAQVLNLIRKFSAEHLCKFLGAGIT   117
                            :*:.:;:**.** *****  :     .     :      *  **;:* ** *:******;*

SEQ_ID_NO:1                 LALLRESPNICTRLWLDLDIVPIVFNIKPFHTDSLTRPNIKHRISSTGSYVPSGAETPT   179
KJA27491.1_H_sublateritium  LLLLKESPNLCTRLWLDMDIVPFVFNIKPFHTDSLTRPNIKHRISSTTGSYVPSGADTPT   135
ADM15725.1_G_frondosa       VILLREAPNLCTRLWLDMDIVPIVFNIKPFHTDSITRPNVRHRISSTTGSYVPSGAETPT   173
KDQ33172.1_P_ostreatus      LALLKECPNLCTRLWLDMDIVPIVFNIKPFHTDSVTRPNIKHRISSTTGSYVPSGSETPT   175
Q9UV63.1_L_sajor-caju       LALLKECPNLCTRLWLDMDIVPIVFNIKPFHTDSVTRPNIKHRISSTTGSYVPSGSETPT   177
                            : **;  **:*********;****;***********;;****;:;****;;:*****

SEQ_ID_NO:1                 VYYEASHLGN--NLSAGTASKLPIPRTLDEQADSAARKAIMYYGPNNNPRLTIGPRMQVA   237
KJA27491.1_H_sublateritium  VVYDSAHLTAMSGLQTGVSGRLPIPRTLDEQADSAARKCLMYFGPGNNPRLSIGPRNQVT   195
ADM15725.1_G_frondosa       VYYDPAQLQDPNKLSANVQTRLPIPRTVDEQADSAARKCIMYFGPNNPRLQIGPRNQVA   233
KDQ33172.1_P_ostreatus      VYYEAAHLGDPSHLSPNAAQKLPIPRTLDEQSDSAARKCLMYFGPNNNPRLSIGARNQVT   235
Q9UV63.1_L_sajor-caju       VYYEASHLGDPSHLSPNAAQKLPIPRTLDEQSDSAARKCLMYFGPNNNPRLSIGARNPVT   237
                            ** :* :       *          :** ** ****** *** **  *** ** * *:
```

Continuation Figure 3

```
SEQ_ID_NO:1                  VDAGGKIHLIDDIDEYRKTVGPSTWTAVNKLADELRERQIKIGFFSSTPQGGVALMRHA  297
KJA27491.1_H_sublateritium   VDSAGKAHLIDDIDEYKATVGPRTWNAVVKLADELREKKIKIGFFSSTPQGGGVALMRHA 255
ADM15725.1_G_frondosa        VDAGGKIHLIDDIDEYRKTVGKGTWNSVIKLADELREKKIKIGFFSSTPQGGGVALMRHA 293
KDQ33172.1_P_ostreatus       VDAGGKIHLIDDLEEYRKTVGTGTWNAVIKLADELREKKVKIGFFSSTPQGGGVALMRHA 295
Q9UV63.1_L_sajor-caju        VDAGGKIHLIDDLEEYRMTVGAGTWNAVIKLADELREKKVKIGFFSSTPQGGGVALMRHA 297
                             **:.** ****:;**:.*** **  **.:** *********:::**************

SEQ_ID_NO:1                  LIRFFSALDVDAAWYVPNPSPSVFRTTKNNHNILQGVASPDLRLTQEAKDNFDAWITKNG 357
KJA27491.1_H_sublateritium   LIRFLTALDVDAAWYVPNPSPSVFRTTKNNHNILQGVAAPDLRLTQEAKDNFDAWILKNG 315
ADM15725.1_G_frondosa        IIRFFTALDVDAAWYVPNPSPSVFRTTKNNHNILQGVADPSLRLTKEAADNFDSWILKNG 353
KDQ33172.1_P_ostreatus       LIRFLTALDVDVAWYVPNPSPQVFRTTKNNHNILQGVAAPDLRLTQDAKDAFDAWILKNG 355
Q9UV63.1_L_sajor-caju        LIRFLTALDVDVAWYVPNPSPQVFRTTKNNHNILQGVAAPDLRLTQEAKDAFDAWILKNG 357
                             ;***;*****;*********;********************;:*  ** ;**:**:***

SEQ_ID_NO:1                  LRWTAEGGPLAPGGVDIAFIDDPQMPGLIPLIKKVRPELPIIYRSHIEIRSDLVHIAGSP 417
KJA27491.1_H_sublateritium   LRWTAEGGPLAPGGVDIAFIDDPQMPGLIPLIKKVRPDLPIVRSHIEIRSDLVHVPGSP  375
ADM15725.1_G_frondosa        LRWTAEGGPLAPGGVDIAFIDDPQVPGLIPLIKRIRPDLPIIYRSHIEIRSDLVHVKGSP 413
KDQ33172.1_P_ostreatus       LRWTAEGGPLAPGGVDVVFIDDPQMPGLIPLIKKVRPEVPIVRSHIEIRSDLVHVAGSP  415
Q9UV63.1_L_sajor-caju        LRWTAEGGPLAPGGVDVVFIDDPQMPGLIPLIKKVRPEVPIVRSHIEIRNDLVHVAWSP  417
                             ****************; ******:********;:**;:**;:********.*****; **

SEQ_ID_NO:1                  QEEVWKYLWNNIQLADLFISHPVKAFVPEDVPIERVALLPAATDWLDGLNKELSDWDRQY 477
KJA27491.1_H_sublateritium   QEEVWKYLWNNIQLADLFISHPVNKFVPSDVPIEKLALLGAATDWLDGLNKELDPWDSQY 435
ADM15725.1_G_frondosa        QEEVWNYLWNNIQHSDLFISHPVNKFVPSDVPLEKLALLGAATDWLGLSKHLDAMDAQY  473
KDQ33172.1_P_ostreatus       QEEVWKYLWNNIQLADLFISHPVSKFVPSDVPIEKLALLGAATDWLNKDLDPWDSQF    475
Q9UV63.1_L_sajor-caju        QEEVWKYLWNNIQLADLFISHPVSKFVPSDVPTEKLALLGAATDWLNKDLDPWDSPF    477
                             *****;*;*****  ;******.  ***;**;;:;***  *****  ::**  *  ;:
```

Continuation Figure 3

```
SEQ_ID_NO:1                    YMGE------------FRALCQKDKMNTLDWPNREYCIQIARFDPAKGIPNVIDSYARFR  525
KJA27491.1_H_sublateritium     YMGE------------FRNLCTKEKMHTLNWPERDYVVQIARFDPAKGINNVIDSYYKFR  483
ADM15725.1_G_frondosa          YMGE------------FRNLCIKEKMNELGWPARDYIVQIARFDPSKGIPNVIDSYARFR  521
KDQ33172.1_P_ostreatus         YMGE------------FRSLCAKEKMVELDWPTRDYIVQVARFDPSKGIPNVVDSYYKFR  523
Q9UV63.1_L_sajor-caju          YMGEFRPRGSHLNRGEFFRSLCAKEKMHELNWPARDYIVQVARFDPSKGIPNVVDSYYKFR 537
                               ****            ** *.**  *.**  :*:****.*** **::**  :*.*

SEQ_ID_NO:1                    RLLNE-AGDVDADDQPQLLICGHGAVDDPQLLTLIH-EKYAEFAKDIVVMRLP         583
KJA27491.1_H_sublateritium     NMLKEKSPDLTEEEHPQLLCGHGAVDDPDASIIYDQVLQLVESEPYKTYAKDIVVMRLP   543
ADM15725.1_G_frondosa          KLCVDK---VMEDDIPQLLCGHGAVDDPDASIIYDQVLQLIH-AKYKEYAPDIVVMRCP   577
KDQ33172.1_P_ostreatus         NLLRTRSPEMELSDHPQLLCGHGAVDDPDASIIYDQIMALVNSDPYKEYAHDIVVMRLP   583
Q9UV63.1_L_sajor-caju          NLLRTRSPDMDESEHPQLLCGHGAVDDPDASIIYDQIMALVNSDPYKEYAHDIVVMRLP   597
                               .:             .***.******** :******:: . *  .:  *******.*

SEQ_ID_NO:1                    PSDQLLDCLMANARIALQLSTREGFEVKVSEAVHAGKPIIAATTGGIPLQVEHGKSGFLT 643
KJA27491.1_H_sublateritium     PSDQLLNALMANSRIALQLSTREGFEVKVSEALHAGKPVIASRTGGIPLQIEHGKSGYLT 603
ADM15725.1_G_frondosa          PSDQLLNTLMANAKFALQLSTREGFEVKVSEALHAGKPVIACRTGGIPLQIEHGKSGYLC 637
KDQ33172.1_P_ostreatus         PSDELLNAMMANSRIALQLSTREGFEVKVSEALHTGKPVIACRTGGIPLQIQHGKSGYLT 643
Q9UV63.1_L_sajor-caju          PSDELLNAMMANSRIALQLSTREGFEVKVSEALHTGKPVIACRTGGIPLQIQHGKSGYLT 657
                               ***:**: :***::.************:***. ******.:: ;:******.;

SEQ_ID_NO:1                    EPGDNAQVARHMYDLYTDVALYDRMSQYARTHVSDEVGTVGNAAAWLYLAAVY-TRGQKL 702
KJA27491.1_H_sublateritium     TAGDNAAVANHLYELYTDEALYRKMSQYAKTHVSDEVGTVGNAASWLYLAVMY-HRGIKI 662
ADM15725.1_G_frondosa          EPGDNAAVAQHMLDLYTDEDLYDTMSEYARTHVSDEVGTVGNAAAWMYLAVMYVSRGVKL 697
KDQ33172.1_P_ostreatus         TPGDNDAVAGYLYDLYTDEALYRRMSDFARTHVSDEVGTVGNAAAWLYLAVMY-SRGEKI 702
Q9UV63.1_L_sajor-caju          TPGEKDAVAGHFYDFYTDEALYRKMSDFARTHVSNEVGTVGNAAAWLYLAVMY-SRGEKI 716
                                .*  * ** :  *:***  **  **::***:*.*********:***.:*  ** :
```

Continuation Figure 3

```
SEQ_ID_NO:1                   APKGAWLNDLLREETGTPYVEGEPRLPRGGIKVQD    737
KJA27491.1_H_sublateritium    KPNGAWLNDMLREETGEEYVEGEPRLPRGGLTMQ-    696
ADM15725.1_G_frondosa         RPHGAWINDLMRTEMGEPYRAGEPRLPRGELHVQG    732
KDQ33172.1_P_ostreatus        KPNGAWINDLLREETGEPYKEGETKLPRTKLDMQG    737
Q9UV63.1_L_sajor-caju         KPNGAWINDFFREETGEPYKEGETKLPRTKLDMQG    751
                              *;***;**;;* *  *  ** ;***  ; ;*
```

TREHALOSE PHOSPHORYLASE

This application is the U.S. national stage of International Patent Application No. PCT/EP2017/080650, filed Nov. 28, 2017, which claims the benefit of European Patent Application No. 16002528.4, filed Nov. 28, 2016.

FIELD OF THE INVENTION

The present invention is related to a phosphorylase, a method for reacting a glucosyl monosaccharide and alpha-D-glucose 1-phosphate, a method for converting glucose and alpha-D-glucose 1-phosphate into trehalose and inorganic phosphate, and the use of the phosphorylase for producing trehalose.

BACKGROUND OF THE INVENTION

Phosphorylases are enzymes which catalyze the addition of a phosphate group from an inorganic phosphate to an acceptor molecule. Phosphorylases which catalyse the reversible phosphorolytic cleavage of trehalose are known in the art and referred to as trehalose phosphorylases. Trehalose phosphorylases can be a distinguished based on the mechanism underlying the reaction catalysed by them.

A first group of trehalose phosphorylases catalyzes phosphorolytic cleavage of trehalose with net retention of the anomeric configuration using inorganic phosphate as a glucosyl acceptor into glucose and alpha-D-glucose 1-phosphate (aG1P) and are therefore classified as retaining phosphorylases. Trehalose phosphorylases of such first group have been assigned EC number EC 2.4.1.231 by the International Union of Biochemistry and Molecular Biology and have been functionally characterized from various eukaryotic fungi.

A second group of trehalose phosphorylases are inverting trehalose phosphorylases to which EC number EC 2.4.1.64 has been assigned and which are catalyzing phosphorolytic cleavage of trehalose with inversion of configuration into glucose and beta-D-glucose 1-phosphate. These phosphorylases thus have a reaction mechanism different from EC 2.4.1.231 trehalose phosphorylases.

Specifically this invention relates to certain phosphorylases of EC number EC 2.4.1.231, that are capable of converting, among other reactions, glucose and alpha-D-glucose-1 phosphate ("aG1P") to trehalose, or of phosphorolytic cleavage of trehalose to glucose and aG1P in the presence of inorganic phosphate.

The industrial use of trehalose phosphorylases results from the fact that the reaction underlying their biochemical characterization, i.e. catalyzing phosphorolytic cleavage of trehalose, is reversible. Because of this, trehalose phospory-lases are particularly useful for catalyzing the conversion of glucose and aG1P to trehalose and inorganic phosphate.

The reaction that is catalyzed by trehalose phosphorylases is reversible (equilibrium reaction) and may undergo substrate or product inhibition, depending on the specific direction of the reaction. In order to obtain industrially relevant amounts of a desired product, trehalose phosphorylases are required that catalyze the conversion of substrates with high specific activity. In addition, other kinetic factors of the trehalose phosphorylases, such as substrate selectivity and $K_M$ may play an important role for product yields. Other relevant aspects may include but are not limited to regioselectivity, inhibition by other factors (e.g. crude extract components, substrate contaminants or side products), and recombinant soluble expression in suitable hosts.

A major shortcoming of wild type trehalose phosphorylases is the rapid loss of enzyme activity in solution even at moderate temperatures between 25° C. and 40° C., which significantly limits their application. For industrial applications, high stability over several days at temperatures above 30° C., or even better above 40° C. is desirable. Long reaction times with thermally instable enzymes requires larger amounts of enzyme over process time, often realized by repeated addition of enzyme throughout the process. For example, trehalose phosphorylase from *Pleurotus ostreatus* shows a half-life of approximately 1.3 h at 25° C. and of 3 min at approximately 41° C. (Schwarz et al., J Biotechnol 129, 140-150 (2007), Han et al., Protein Expression and Purification 30, 194-202 (2003)). The trehalose phosphorylases from *Schizophyllum commune* and *Grifola frondosa* are slightly more stable with half-lives of 4.8 h at 30° C. and of 1 h at 37° C., respectively (Schwarz et al., J Biotechnol 129, 140-150 (2007)).

Various strategies were applied in the art to address such shortcomings. For example, addition of trehalose, glycerol and polyethylene glycol (PEG) was shown to increase trehalose phosphorylases stability (Klimacek et al., Biotechnology Techniques 13: 243-248, 1999, Eis et al., Biochem J 341, 385-393 (1999), Schwarz et al. J Biotechnol 129, 140-150 (2007)). The best stabilization was achieved by adding 20% PEG 4000, which resulted in half-lives of trehalose phosphorylase from *Schizophyllum commune* at 30° C., 40° C. and 50° C. of 4.5 days, 2.2 hours and 6 min, respectively (Klimacek et al., Biotechnology Techniques 13: 243-248, 1999, Eis et al., Biochem J 341, 385-393 (1999)). While the addition of PEG 4000 improved the stability of the enzyme, such improvement is still insufficient for applications at or above 40° C. and process times of several hours to several days. The presence of PEG 4000 may furthermore interfere with industrial scale cost structure and downstream processing requirements for the products obtained by the enzymatic reaction.

Half-life of trehalose phosphorylases from *Schizophyllum commune* could also be improved by immobilization to 22 days, 3.3 days and 2 hours at 30° C., 40° C. and 50° C., respectively (Klimacek et al., Biotechnology Techniques 13: 243-248, 1999). Immobilization, however, results in higher enzyme production costs due to expensive carrier and manufacturing costs, and is efficient in terms of industrial applicability only if the enzyme can be recovered and reused for multiple cycles. Additionally, immobilization limits process and down-stream processing options for products of the enzymatic reaction.

It is therefore not surprising that synthesis reactions employing trehalose phosphorylases are conducted at temperatures ranging from 25° C. to 35° C. (Schwarz et al., J of Biotechnology 129 140-150 (2007), Saito et al., Appl Microbiol Biotechnol 50:193-198 (1998), Saito et al. Appl Microbiol Biotechnol 64: 4340-4345 (1998)).

A further approach for improving performance of enzymes and their suitability for use in industrial processes is enzyme engineering. This technique involves developing variants of a starting enzyme with improved properties (for review, see, for example, S. Lutz, U. T. Bornscheuer, Protein Engineering Handbook, Wiley VCH, Weinheim, 2009). Among others, phosphorylases were improved by enzyme engineering. For example, US 2013-0029384 discloses variants of a sucrose phosphorylase belonging to glycosyl hydrolase family 13 having improved thermal stability. Variants of trehalose phosphorylase of EC number EC 2.4.1.231 have so far been limited to variants for elucidation of the reaction mechanism of said trehalose phosphorylase.

Based on such variants, Goedl et al. (Biochem J 397; 491-500; 2006) discovered that substitutions at amino acid positions D379, H403, R507 and K512 of trehalose phosphorylase from *Shizophyllum commune* led to a reduction in activity. The variants having one of the following single mutations D379N, H403A, R507A and K512A showed reduced activity for trehalose phosphorolysis. Goedl et al. (FEBS J 275; 903-913, 2008) more specifically found that mutations R507A and K512A of trehalose phosphorylase from *Shizophyllum commune* had an impact on catalytic efficiency of trehalose phosphorylase of the wild type (kcat/ $K_M$).

As the wild type trehalose phosphorylases available from the prior art are not satisfactory in every respect, and attempts to efficiently improve the industrial applicability of trehalose phosphorylases, as described in the art were not successful, there is a need for trehalose phosphorylases which are advantageous compared to wild type trehalose phosphorylases, in particular with respect to process stability at high temperatures for the industrial production of trehalose.

Accordingly, the problem underlying the present invention is the provision of a trehalose phosphorylase which is suitable for use in industrial production of trehalose.

A further problem underlying the present invention is the provision of a trehalose phosphorylase which is thermally stable and shows a residual activity ranging from 30% to 90% or from 55% to 100% after incubation at 52° C. for 15 minutes without the necessity of immobilizing the enzyme or adding any stabilizing agent (e.g., PEG or glycerol) apart from sucrose.

Another problem underlying the present invention is the provision of a trehalose phosphorylase which is thermally stable and shows a half-life at 45° C. from 3 hours to 9 days or more without the necessity of immobilizing the enzyme or adding any stabilizing agent (e.g., PEG or glycerol) apart from sucrose.

Another problem underlying the present invention is the provision of a trehalose phosphorylase which has a 100/500-ratio ranging between 0.65 and 1.0.

A still further problem is the provision of means which allow converting glucose and alpha-D-glucose 1-phosphate into trehalose and inorganic phosphate.

SUMMARY OF THE INVENTION

These and other problems are solved by the attached independent claims. Preferred embodiments may be taken from the attached dependent claims.

More specifically, these and other problems are solved in a first aspect, which is also the first embodiment of the first aspect, by a polypeptide, preferably a trehalose phosphorylase, comprising an amino acid sequence, wherein the amino acid sequence of the trehalose phosphorylase is at least 80% identical to and/or at least 80% homologous to an amino acid sequence of SEQ ID NO:1, wherein the amino acid sequence of the trehalose phosphorylase comprises an amino acid substitution at one or more amino acid positions, wherein the one or more amino acid positions is/are selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1. Preferably, the one or more amino acid positions is/are individually and independently selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1. Even more preferably, the one or more amino acid positions is/are individually and independently selected from the group consisting of amino acid positions 712, 383, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 667, 703 and 705 of SEQ ID NO: 1. As surprisingly found in the context of the present invention, the mutation of one or more of these positions resulted in improved characteristics in comparison to the wild type sequence of SEQ ID NO: 1, for example in an increased thermal stability of the enzyme leading to a residual activity after 15 min incubation at 52° C. of at least 22% in comparison to 19% of trehalose phosphorylase encoded by the wild type amino acid sequence of SEQ ID NO: 1.

In a second embodiment of the first aspect which is also an embodiment of the first embodiment of the first aspect, the one or more amino acid positions is/are selected from the group consisting of amino acid positions of L712, P383, V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705 of SEQ ID NO: 1.

In a third embodiment of the first aspect which is also an embodiment of the first and the second embodiment of the first aspect, the one or more amino acid positions is/are selected from the group consisting of amino acid positions 712, 383, 10, 114, 118, 220, 225, 304, 318, 323, 349, 357, 481, 487, 488, 506, 511, 550, 556, 564, 590, 649, 703 and 705 of SEQ ID NO: 1.

In a fourth embodiment of the first aspect which is also an embodiment of the first, second and third embodiment of the first aspect, the one or more amino acid positions is/are selected from the group consisting of amino acid positions L712, P383, V10, L114, I118, Y220, N225, A304, P318, T323, F349, G357, E481, Q487, K488, A506, A511, V550, S556, T564, D590, A649, A703 and K705 of SEQ ID NO: 1.

In a fifth embodiment of the first aspect which is also an embodiment of the first, second, third and fourth embodiment of the first aspect, the one or more amino acid positions is/are selected from the group consisting of amino acid positions 712, 383, 114, 118, 225, 304, 323, 349, 357, 487, 550, 556, 564, 590 and 649 of SEQ ID NO: 1.

In a sixth embodiment of the first aspect which is also an embodiment of the first, second, third, fourth and fifth embodiment of the first aspect, preferably of the fifth embodiment of the first aspect, the one or more amino acid positions is/are selected from the group consisting of amino acid positions L712, P383, L114, I118, N225, A304, T323, F349, G357, Q487, V550, S556, T564, D590 and A649 of SEQ ID NO: 1.

In another preferred embodiment of the first aspect, which is also an embodiment of any of the previous embodiments of the first aspect, the one or more amino acid positions is/are selected from the group consisting of amino acid positions 383, 225, 304, 323, 487, 550, 556, 564, 590, and 705 of SEQ ID NO: 1.

In another preferred embodiment of the first aspect, which is also an embodiment of any of the previous embodiments of the first aspect, the one or more amino acid positions is/are selected from the group consisting of amino acid positions 383, 225, 304, 487, 556, 590 and 705 of SEQ ID NO: 1.

In another preferred embodiment of the first aspect, which is also an embodiment of any of the previous embodiments of the first aspect, the one or more amino acid positions is/are selected from the group consisting of amino acid positions 383, 225, 304, 487, 556, and 590 of SEQ ID NO: 1.

In another preferred embodiment of the first aspect, which is also an embodiment of any of the previous embodiments of the first aspect, the one or more amino acid positions is/are selected from the group consisting of amino acid positions 383, 556, and 590 of SEQ ID NO: 1.

In another preferred embodiment of the first aspect, which is also an embodiment of any of the previous embodiments of the first aspect, the one or more amino acid positions is/are selected from the group consisting of amino acid positions 383 and 590 of SEQ ID NO: 1.

In another preferred embodiment of the first aspect, which is also an embodiment of any of the previous embodiments of the first aspect, the one or more amino acid positions is the amino acid position 383 of SEQ ID NO: 1.

In another preferred embodiment of the first aspect, which is also an embodiment of any of the previous embodiments of the first aspect, the one or more amino acid positions is/are selected from the group consisting of amino acid positions P383, N225, A304, T323, Q487, V550, S556, T564, D590 and N705 of SEQ ID NO: 1.

In another preferred embodiment of the first aspect, which is also an embodiment of any of the previous embodiments of the first aspect, the amino acid sequence of the trehalose phosphorylase comprises an amino acid sequence according to any one of SEQ ID NO: 2, 84, 85, 86, 87, 88, 89, 90, 91, 92, 93, 94, 95, 96, 97, 98, 99, 100, 101, 102, 103, 104, 105, 106, 107, 108, 109, preferably according to any one of SEQ ID NO: 2, 84, 85, 87, 88, 89, 91, 92, 93, 94, 95, 97, 98, 99, 100, 101, 102, 103, 104, 105, 106, 107, 109, more preferably according to any one of SEQ ID NO: 84, 85, 87, 88, 89, 91, 92, 93, 94, 95, 97, 98, 99, 100, 101, 102, 103, 104, 105, 106, 107, 109, equally preferably according to any one of SEQ ID NO: 87, 89, 91, 97, 98, 99, 100, 101, 102, 103, 104, 109, even more preferably according to any one of SEQ ID NO: 87, 91, 97, 98, 99, 100, 101, 102, 103, 104, 109, and most preferably according to any one of SEQ ID NO: 87, 97, 98, 99, 100, 101, 102, 103, 104.

In a seventh embodiment of the first aspect which is also an embodiment of the first, second, third, fourth, fifth and sixth embodiment or of any other of the previous embodiments of the first aspect, the one or more amino acid positions is two or more amino acid positions.

In an eighth embodiment of the first aspect which is also an embodiment of the first, second, third, fourth, fifth, sixth and seventh embodiment or of any other of the previous embodiments of the first aspect, preferably of the seventh embodiment of the first aspect, the one or more amino acid positions is three or more amino acid positions.

In a ninth embodiment of the first aspect which is also an embodiment of the first, second, third, fourth, fifth, sixth, seventh and eighth embodiment or of any other of the previous embodiments of the first aspect, preferably of the eighth embodiment of the first aspect, the one or more amino acid positions is four or more amino acid positions.

In a tenth embodiment of the first aspect which is also an embodiment of the first, second, third, fourth, fifth, sixth, seventh, eighth and ninth embodiment or of any other of the previous embodiments of the first aspect, preferably of the ninth embodiment of the first aspect, the one or more amino acid positions is five or more amino acid positions.

In an eleventh embodiment of the first aspect which is also an embodiment of the first, second, third, fourth, fifth, sixth, seventh, eighth, ninth and tenth embodiment or of any other of the previous embodiments of the first aspect, preferably of the tenth embodiment of the first aspect, the one or more amino acid positions is six or more amino acid positions.

In a twelfth embodiment of the first aspect which is also an embodiment of the first, second, third, fourth, fifth, sixth, seventh, eighth, ninth, tenth and eleventh embodiment or of any other of the previous embodiments of the first aspect, preferably of the eleventh embodiment of the first aspect, the one or more amino acid positions is seven or more amino acid positions.

In a 13$^{th}$ embodiment of the first aspect which is also an embodiment of the first, second, third, fourth, fifth, sixth, seventh, eighth, ninth, tenth, eleventh and twelfth embodiment or of any other of the previous embodiments of the first aspect, preferably of the twelfth embodiment of the first aspect, the one or more amino acid positions is eight or more amino acid positions.

In a 14$^{th}$ embodiment of the first aspect which is also an embodiment of the first, second, third, fourth, fifth, sixth, seventh, eighth, ninth, tenth, eleventh, twelfth and 13$^{th}$ embodiment or of any other of the previous embodiments of the first aspect, preferably of the 13$^{th}$ embodiment of the first aspect, the one or more amino acid positions is nine or more amino acid positions.

In a 15$^{th}$ embodiment of the first aspect which is also an embodiment of the first, second, third, fourth, fifth, sixth, seventh, eighth, ninth, tenth, eleventh, twelfth, 13$^{th}$ and 14$^{th}$ embodiment or of any other of the previous embodiments of the first aspect, preferably of the 14$^{th}$ embodiment of the first aspect, the one or more amino acid positions is ten or more amino acid positions.

In a 16$^{th}$ embodiment of the first aspect which is also an embodiment of the first, second, third, fourth, fifth, sixth, seventh, eighth, ninth, tenth, eleventh, twelfth, 13$^{th}$, 14$^{th}$ and 15$^{th}$ embodiment or of any other of the previous embodiments of the first aspect, preferably of the 15$^{th}$ embodiment of the first aspect, the one or more amino acid positions is eleven or more amino acid positions.

In a 17$^{th}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$ and 16$^{th}$ embodiment or of any other of the previous embodiments of the first aspect, preferably of the 16$^{th}$ embodiment of the first aspect, the one or more amino acid positions is twelve or more amino acid positions.

In an 18$^{th}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$ and 17$^{th}$ embodiment or of any other of the previous embodiments of the first aspect, preferably of the 17$^{th}$ embodiment of the first aspect, the one or more amino acid positions is 13 or more amino acid positions.

In a 19$^{th}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$ and 18$^{th}$ embodiment or of any other of the previous embodiments of the first aspect, preferably of the 18$^{th}$ embodiment of the first aspect, the one or more amino acid positions is 14 or more amino acid positions.

In a 20$^{th}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$, 18$^{th}$ and 19$^{th}$ embodiment or of any other of the previous embodiments of the first aspect, preferably of the seventh, eighth, ninth, tenth, eleventh, twelfth, 13$^{th}$, 14$^{th}$, 15$^{th}$, 16$^{th}$, 17$^{th}$, 18$^{th}$ and 19$^{th}$ embodiment of the first aspect, each and any of the amino acid positions is selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1, preferably each and any of the amino acid positions is independently and individually selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1.

In a 21$^{st}$ embodiment of the first aspect which is also an embodiment of the 20$^{th}$ embodiment of the first aspect, each and any of the amino acid positions is selected from the group consisting of amino acid positions L712, P383, V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705 of SEQ ID NO: 1, preferably each and any of the amino acid positions is independently and individually selected from the group consisting of amino acid positions L712, P383, V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705 of SEQ ID NO: 1.

In a 22$^{nd}$ embodiment of the first aspect which is also an embodiment of the 20$^{th}$ embodiment of the first aspect, each and any of the amino acid positions is selected from the group consisting of amino acid positions 712, 383, 10, 114, 118, 220, 225, 304, 318, 323, 349, 357, 481, 487, 488, 506, 511, 550, 556, 564, 590, 649, 703 and 705 of SEQ ID NO: 1, preferably each and any of the amino acid positions is independently and individually selected from the group consisting of amino acid positions 712, 383, 10, 114, 118, 220, 225, 304, 318, 323, 349, 357, 481, 487, 488, 506, 511, 550, 556, 564, 590, 649, 703 and 705 of SEQ ID NO: 1.

In a 23$^{rd}$ embodiment of the first aspect which is also an embodiment of the 22$^{nd}$ embodiment of the first aspect, each and any of the amino acid positions is selected from the group consisting of amino acid positions L712, P383, V10, L114, I118, Y220, N225, A304, P318, T323, F349, G357, E481, Q487, K488, A506, A511, V550, S556, T564, D590, A649, A703 and K705 of SEQ ID NO: 1, preferably each and any of the amino acid positions is independently and individually selected from the group consisting of amino acid positions L712, P383, V10, L114, I118, Y220, N225, A304, P318, T323, F349, G357, E481, Q487, K488, A506, A511, V550, S556, T564, D590, A649, A703 and K705 of SEQ ID NO: 1.

In a 24$^{th}$ embodiment of the first aspect which is also an embodiment of the 22$^{nd}$ embodiment of the first aspect, each and any of the amino acid positions is selected from the group consisting of amino acid positions 712, 383, 114, 118, 225, 304, 323, 349, 357, 487, 550, 556, 564, 590 and 649 of SEQ ID NO: 1, preferably each and any of the amino acid positions is independently and individually selected from the group consisting of amino acid positions 712, 383, 114, 118, 225, 304, 323, 349, 357, 487, 550, 556, 564, 590 and 649 of SEQ ID NO: 1.

In a 25$^{th}$ embodiment of the first aspect which is also an embodiment of the 24$^{th}$ embodiment of the first aspect, each and any of the amino acid positions is selected from the group consisting of amino acid positions L712, P383, L114, I118, N225, A304, T323, F349, G357, Q487, V550, S556, T564, D590 and A649 of SEQ ID NO: 1, preferably each and any of the amino acid positions is independently and individually selected from the group consisting of amino acid positions L712, P383, L114, I118, N225, A304, T323, F349, G357, Q487, V550, S556, T564, D590 and A649 of SEQ ID NO: 1.

In a 26$^{th}$ embodiment of the first aspect which is also an embodiment of the seventh, eighth, ninth, tenth, eleventh, twelfth, 13$^{th}$, 14$^{th}$, 15$^{th}$, 16$^{th}$, 17$^{th}$, 18$^{th}$, 19$^{th}$, 20$^{th}$, 21$^{st}$, 22$^{nd}$, 23$^{rd}$, 24$^{th}$ and 25$^{th}$ embodiment of the first aspect, the two or more amino acid positions comprises a pair of two amino acid positions, wherein the pair of two amino acid positions is selected from the group consisting of 10 and 114, 10 and 118, 10 and 220, 10 and 225, 10 and 304, 10 and 323, 10 and 349, 10 and 357, 10 and 383, 10 and 487, 10 and 506, 10 and 550, 10 and 556, 10 and 564, 10 and 590, 10 and 649, 10 and 705, 10 and 712, 114 and 118, 114 and 220, 114 and 225, 114 and 304, 114 and 323, 114 and 349, 114 and 357, 114 and 383, 114 and 487, 114 and 506, 114 and 550, 114 and 556, 114 and 564, 114 and 590, 114 and 649, 114 and 705, 114 and 712, 118 and 220, 118 and 225, 118 and 304, 118 and 323, 118 and 349, 118 and 357, 118 and 383, 118 and 487, 118 and 506, 118 and 550, 118 and 556, 118 and 564, 118 and 590, 118 and 649, L118 and 705, 118 and 712, 220 and 225, 220 and 304, 220 and 323, 220 and 349, 220 and 357, 220 and 383, 220 and 487, 220 and 506, 220 and 550, 220 and 556, 220 and 564, 220 and 590, 220 and 649, 220 and 705, 220 and 712, 225 and 304, 225 and 323, 225 and 349, 225 and 357, 225 and 383, 225 and 487, 225 and 506, 225 and 550, 225 and 556, 225 and 564, 225 and 590, 225 and 649, 225 and 705, 225 and 712, 304 and 323, 304 and 349, 304 and 357, 304 and 383, 304 and 487, 304 and 506, 304 and 550, 304 and 556, 304 and 564, 304 and 590, 304 and 649, 304 and 705, 304 and 712, 323 and 349, 323 and 357, 323 and 383, 323 and 487, 323 and 506, 323 and 550, 323 and 556, 323 and 564, 323 and 590, 323 and 649, 323 and 705, 323 and 712, 349 and 357, 349 and 383, 349 and 487, 349 and 506, 349 and 550, 349 and 556, 349 and 564, 349 and 590, 349 and 649, 349 and 705, 349 and 712, 357 and 383, 357 and 487, 357 and 506, 357 and 550, 357 and 556, 357 and 564, 357 and 590, 357 and 649, 357 and 705, 357 and 712, 383 and 487, 383 and 506, 383 and 550, 383 and 556, 383 and 564, 383 and 590, 383 and 649, 383 and 705, 383 and 712, 487 and 506, 487 and 550, 487 and 556, 487 and 564, 487 and 590, 487 and 649, 487 and 705, 487 and 712, 506 and 550, 506 and 556, 506 and 564, 506 and 590, 506 and 649, 506 and 705, 506 and 712, 550 and 556, 550 and 564, 550 and 590, 550 and 649, 550 and 705, 550 and 712, 556 and 564, 556 and 590, 556 and 649, 556 and 705, 556 and 712, 564 and 590, 564 and 649, 564 and 705, 564 and 712, 590 and 649, 590 and 705, 590 and 712, 649 and 712, 649 and 705, and 705 and 712, and preferably the pair of two amino acid positions is selected from the group consisting of V10 and L114, V10 and I118, V10 and Y220, V10 and N225, V10 and A304, V10 and T323, V10 and F349, V10 and G357, V10 and P383, V10 and Q487, V10 and A506, V10 and V550, V10 and S556, V10 and T564, V10 and D590, V10 and A649, V10 and K705, V10 and L712, L114 and I118, L114 and Y220, L114 and N225, L114 and A304, L114 and T323, V10 and F349, L114 and G357, L114 and P383, L114 and Q487, L114 and A506, L114 and V550, L114 and S556, L114 and T564, L114 and D590, L114 and A649, L114 and K705, L114 and L712, I118 and Y220, I118 and N225, I118 and A304, I118 and T323, I118 and F349, I118 and G357, I118 and P383, I118 and Q487, I118 and A506, I118 and V550, I118 and S556, I118 and T564, I118 and D590, I18 and A649, L118 and K705, I118 and L712, Y220 and N225, Y220 and A304, Y220 and T323, Y220 and F349, Y220 and G357, Y220 and P383, Y220 and Q487, Y220 and A506, Y220 and V550, Y220 and S556, Y220 and T564, Y220 and D590, Y220 and A649, Y220 and K705, Y220 and L712, N225 and A304, N225 and T323, N225 and F349, N225 and G357, N225 and P383, N225 and Q487, N225 and A506, N225 and V550, N225 and S556, N225 and T564, N225 and D590, N225 and A649, N225 and K705, N225 and L712, A304 and T323, A304 and F349, A304 and G357, A304 and P383, A304 and Q487, A304 and A506, A304 and V550, A304 and S556, A304 and T564, A304 and D590, A304 and A649, A304 and K705, A304 and L712, T323 and F349, T323 and G357, T323 and P383, T323 and Q487, T323 and A506, T323 and V550, T323 and S556, T323 and T564, T323 and D590, T323 and A649, T323 and K705, T323 and L712, F349 and G357, F349 and P383, F349 and Q487, F349 and A506, F349 and V550, F349 and S556, F349 and T564, F349 and D590, F349 and A649, F349 and K705, F349 and L712, G357 and P383, G357 and Q487, G357 and A506, G357 and V550, G357 and S556, G357 and T564, G357 and D590, G357 and A649, G357 and K705, G357 and L712, P383 and Q487, P383 and A506, P383 and V550, P383 and S556, P383 and T564, P383 and D590, P383 and A649, P383 and K705, P383 and L712, Q487 and A506, Q487 and V550, Q487 and S556, Q487 and T564, Q487 and D590, Q487 and A649, Q487 and K705, Q487 and L712, A506 and V550, A506 and S556, A506 and T564, A506 and D590, A506 and A649, A506 and K705, A506 and L712, V550 and S556, V550 and T564, V550 and D590, V550 and A649, V550 and K705, V550 and L712, S556 and T564, S556 and D590, S556 and A649, S556 and K705, S556 and L712, T564 and D590, T564 and A649, T564 and K705, T564 and L712, D590 and A649, D590 and K705, D590 and L712, A649 and L712, A649 and K705, and K705 and L712.

In a 27th embodiment of the first aspect which is also an embodiment of the 26th embodiment of the first aspect, the pair of two amino acid positions is selected from the group consisting of 10 and 114, 10 and 220, 10 and 383, 10 and 506, 10 and 705, 10 and 712, 114 and 118, 114 and 220, 114 and 225, 114 and 304, 114 and 225, 114 and 349, 114 and 357, 114 and 383, 114 and 487, 114 and 506, 114 and 550, 114 and 556, 114 and 564, 114 and 590, 114 and 649, 114 and 705, 114 and 712, 118 and 225, 118 and 304, 118 and 323, 118 and 349, 118 and 357, 118 and 383, 118 and 487, 118 and 550, 118 and 556, 118 and 564, 118 and 590, 118 and 649, 118 and 712, 220 and 383, 220 and 506, 220 and 705, 220 and 712, 225 and 304, 225 and 323, 225 and 349, 225 and 357, 225 and 383, 225 and 487, 225 and 550, 225 and 556, 225 and 564, 225 and 590, 225 and 649, 225 and 712, 304 and 323, 304 and 349, 304 and 357, 304 and 383, 304 and 487, 304 and 550, 304 and 556, 304 and 564, 304 and 590, 304 and 649, 304 and 712, 323 and 349, 323 and 357, 323 and 383, 323 and 487, 323 and 550, 323 and 556, 323 and 564, 323 and 590, 323 and 649, 323 and 712, 349 and 357, 349 and 383, 349 and 487, 349 and 550, 349 and 556, 349 and 564, 349 and 590, 349 and 649, 349 and 712, 357 and 383, 357 and 487, 357 and 550, 357 and 556, 357 and 564, 357 and 590, 357 and 649, 357 and 705, 357 and 712, 383 and 487, 383 and 506, 383 and 550, 383 and 556, 383 and 564, 383 and 590, 383 and 649, 383 and 705, 383 and 712, 487 and 550, 487 and 556, 487 and 564, 487 and 590, 487 and 649, 487 and 712, 506 and 705, 506 and 712, 550 and 556, 550 and 564, 550 and 590, 550 and 649, 550 and 712, 556 and 564, 556 and 590, 556 and 649, 556 and 712, 564 and 590, 564 and 649, 564 and 712, 590 and 649, 590 and 712, 649 and 712, 705 and 712, and preferably the pair of two amino acid positions is selected from the group consisting of V10 and L114, V10 and Y220, V10 and P383, V10 and A506, V10 and K705, V10 and L712, L114 and I118, L114 and Y220, L114 and N225, L114 and A304, L114 and T323, L114 and F349, L114 and G357, L114 and P383, L114 and Q487, L114 and A506, L114 and V550, L114 and S556, L114 and T564, L114 and D590, L114 and A649, L114 and K705, L114 and L712, I118 and N225, I118 and A304, I118 and T323, I118 and F349, I118 and G357, I118 and P383, I118 and Q487, I118 and V550, I118 and S556, I118 and T564, I118 and D590, I18 and A649, I118 and L712, Y220 and P383, Y220 and A506, Y220 and K705, Y220 and L712, N225 and A304, N225 and T323, N225 and F349, N225 and G357, N225 and P383, N225 and Q487, N225 and V550, N225 and S556, N225 and T564, N225 and D590, N225 and A649, N225 and L712, A304 and T323, A304 and F349, A304 and G357, A304 and P383, A304 and Q487, A304 and V550, A304 and S556, A304 and T564, A304 and D590, A304 and A649, A304 and L712, T323 and F349, T323 and G357, T323 and P383, T323 and Q487, T323 and V550, T323 and S556, T323 and T564, T323 and D590, T323 and A649, T323 and L712, F349 and G357, F349 and P383, F349 and Q487, F349 and V550, F349 and S556, F349 and T564, F349 and D590, F349 and A649, F349 and L712, G357 and P383, G357 and Q487, G357 and V550, G357 and S556, G357 and T564, G357 and D590, G357 and A649, G357 and K705, G357 and L712, P383 and Q487, P383 and A506, P383 and V550, P383 and S556, P383 and T564, P383 and D590, P383 and A649, P383 and K705, P383 and L712, Q487 and V550, Q487 and S556, Q487 and T564, Q487 and D590, Q487 and A649, Q487 and L712, A506 and K705, A506 and L712, V550 and S556, V550 and T564, V550 and D590, V550 and A649, V550 and L712, S556 and T564, S556 and D590, S556 and A649, S556 and L712, T564 and D590, T564 and A649, T564 and L712, D590 and A649, D590 and L712, A649 and L712, K705 and L712.

In a 28th embodiment of the first aspect which is also an embodiment of the 27th embodiment of the first aspect, the pair of two amino acid positions is selected from the group consisting of 10 and 114, 10 and 712, 114 and 118, 114 and 304, 114 and 357, 114 and 383, 114 and 590, 114 and 712, 118 and 304, 118 and 357, 118 and 383, 118 and 556, 118 and 564, 118 and 590, 118 and 712, 225 and 304, 225 and 383, 225 and 487, 225 and 550, 225 and 556, 225 and 590, 304 and 323, 304 and 357, 304 and 383, 304 and 487, 304 and 556, 304 and 564, 304 and 590, 304 and 712, 323 and 357, 323 and 487, 323 and 556, 323 and 564, 323 and 590, 323 and 649, 349 and 383, 349 and 590, 357 and 383, 357 and 590, 357 and 705, 357 and 712, 383 and 487, 383 and 550, 383 and 556, 383 and 564, 383 and 590, 383 and 649, 383 and 712, 487 and 564, 487 and 590, 487 and 649, 550 and 590, 556 and 564, 556 and 590, 556 and 649, 564 and 590, 564 and 712, 590 and 649, 590 and 712, and 649 and 712, and preferably the pair of two amino acid positions is selected from the group consisting of V10 and L114, V10 and L712, L114 and I118, L114 and A304, L114 and G357, L114 and P383, L114 and D590, L114 and L712, I118 and A304, I118 and G357, I118 and P383, I118 and S556, I118 and T564, I118 and D590, I118 and L712, N225 and A304, N225 and P383, N225 and Q487, N225 and V550, N225 and S556, N225 and D590, A304 and T323, A304 and G357, A304 and P383, A304 and Q487, A304 and S556, A304 and T564, A304 and D590, A304 and L712, T323 and G357, T323 and Q487, T323 and S556, T323 and T564, T323 and D590, T323 and A649, F349 and P383, F349 and D590, G357 and P383, G357 and D590, G357 and K705, G357 and L712, P383 and Q487, P383 and V550, P383 and S556, P383 and T564, P383 and D590, P383 and A649, P383 and L712, Q487 and T564, Q487 and D590, Q487 and A649, V550 and D590, S556 and T564, S556 and D590, S556 and A649, T564 and D590, T564 and L712, D590 and A649, D590 and L712, and A649 and L712.

In a 29$^{th}$ embodiment of the first aspect which is also an embodiment of the 28$^{th}$ embodiment of the first aspect, the pair of two amino acid positions is selected from the group consisting of 114 and 118, 114 and 304, 114 and 357, 114 and 383, 114 and 590, 114 and 712, 118 and 304, 118 and 357, 118 and 383, 118 and 556, 118 and 564, 118 and 590, 118 and 712, 225 and 304, 225 and 383, 225 and 487, 225 and 550, 225 and 556, 225 and 590, 304 and 323, 304 and 357, 304 and 383, 304 and 487, 304 and 556, 304 and 564, 304 and 590, 304 and 712, 323 and 357, 323 and 487, 323 and 556, 323 and 564, 323 and 590, 323 and 649, 349 and 383, 349 and 590, 357 and 383, 357 and 590, 357 and 705, 357 and 712, 383 and 487, 383 and 550, 383 and 556, 383 and 564, 383 and 590, 383 and 649, 383 and 712, 487 and 564, 487 and 590, 487 and 649, 550 and 590, 556 and 564, 556 and 590, 556 and 649, 564 and 590, 564 and 712, 590 and 649, 590 and 712, and 649 and 712, and preferably the pair of two amino acid positions is selected from the group consisting of L114 and I118, L114 and A304, L114 and G357, L114 and P383, L114 and D590, L114 and L712, I118 and A304, I118 and G357, I118 and P383, I118 and S556, I118 and T564, I118 and D590, I118 and L712, N225 and A304, N225 and P383, N225 and Q487, N225 and V550, N225 and S556, N225 and D590, A304 and T323, A304 and G357, A304 and P383, A304 and Q487, A304 and S556, A304 and T564, A304 and D590, A304 and L712, T323 and G357, T323 and Q487, T323 and S556, T323 and T564, T323 and D590, T323 and A649, F349 and P383, F349 and D590, G357 and P383, G357 and D590, G357 and K705, G357 and L712, P383 and Q487, P383 and V550, P383 and S556, P383 and T564, P383 and D590, P383 and A649, P383 and L712, Q487 and T564, Q487 and D590, Q487 and A649, V550 and D590, S556 and T564, S556 and D590, S556 and A649, T564 and D590, T564 and L712, D590 and A649, D590 and L712, and A649 and L712.

In another preferred embodiment of the first aspect, which is also an embodiment of any other of the previous embodiments of the first aspect, the pair of two amino acid positions is selected from the group consisting of 114 and 118, 114 and 304, 114 and 357, 114 and 383, 114 and 590, 114 and 712, 118 and 304, 118 and 357, 118 and 383, 118 and 556, 118 and 564, 118 and 590, 118 and 712, 225 and 304, 225 and 383, 225 and 487, 225 and 550, 225 and 556, 225 and 590, 304 and 323, 304 and 357, 304 and 383, 304 and 487, 304 and 556, 304 and 564, 304 and 590, 304 and 712, 323 and 357, 323 and 487, 323 and 556, 323 and 564, 323 and 590, 349 and 383, 349 and 590, 357 and 383, 357 and 590, 357 and 705, 357 and 712, 383 and 487, 383 and 550, 383 and 556, 383 and 564, 383 and 590, 383 and 712, 487 and 564, 487 and 590, 550 and 590, 556 and 564, 556 and 590, 564 and 590, 564 and 712, and 590 and 712, and preferably the pair of two amino acid positions is selected from the group consisting of L114 and I118, L114 and A304, L114 and G357, L114 and P383, L114 and D590, L114 and L712, I118 and A304, I118 and G357, I118 and P383, I118 and S556, I118 and T564, I118 and D590, I118 and L712, N225 and A304, N225 and P383, N225 and Q487, N225 and V550, N225 and S556, N225 and D590, A304 and T323, A304 and G357, A304 and P383, A304 and Q487, A304 and S556, A304 and T564, A304 and D590, A304 and L712, T323 and G357, T323 and Q487, T323 and S556, T323 and T564, T323 and D590, F349 and P383, F349 and D590, G357 and P383, G357 and D590, G357 and K705, G357 and L712, P383 and Q487, P383 and V550, P383 and S556, P383 and T564, P383 and D590, P383 and L712, Q487 and T564, Q487 and D590, V550 and D590, S556 and T564, S556 and D590, T564 and D590, T564 and L712, and D590 and L712.

In a 30$^{th}$ embodiment of the first aspect which is also an embodiment of the 29$^{th}$ embodiment of the first aspect, the pair of two amino acid positions is selected from the group consisting of 118 and 383, 118 and 556, 118 and 564, 118 and 590, 225 and 304, 225 and 383, 225 and 487, 225 and 550, 225 and 556, 225 and 590, 304 and 323, 304 and 383, 304 and 487, 304 and 556, 304 and 564, 304 and 590, 323 and 357, 323 and 487, 323 and 556, 323 and 564, 323 and 590, 323 and 649, 349 and 383, 349 and 590, 357 and 383, 357 and 590, 383 and 487, 383 and 550, 383 and 556, 383 and 564, 383 and 590, 383 and 649, 383 and 712, 487 and 564, 487 and 590, 487 and 649, 550 and 590, 556 and 564, 556 and 590, 556 and 649, 564 and 590, 564 and 712, 590 and 649, 590 and 712, 649 and 712, and 705 and 712, and preferably the pair of two amino acid positions is selected from the group consisting of I118 and P383, I118 and S556, I118 and T564, I118 and D590, N225 and A304, N225 and P383, N225 and Q487, N225 and V550, N225 and S556, N225 and D590, A304 and T323, A304 and P383, A304 and Q487, A304 and S556, A304 and T564, A304 and D590, T323 and G357, T323 and Q487, T323 and S556, T323 and T564, T323 and D590, T323 and A649, F349 and P383, F349 and D590, G357 and P383, G357 and D590, P383 and Q487, P383 and V550, P383 and S556, P383 and T564, P383 and D590, P383 and A649, P383 and L712, Q487 and T564, Q487 and D590, Q487 and A649, V550 and D590, S556 and T564, S556 and D590, S556 and A649, T564 and D590, T564 and L712, D590 and A649, D590 and L712, A649 and L712, and K705 and L712.

In another preferred embodiment of the first aspect, which is also an embodiment of any other of the previous embodiments of the first aspect, the pair of two amino acid positions is selected from the group consisting of 118 and 383, 118 and 556, 118 and 564, 118 and 590, 225 and 304, 225 and 383, 225 and 487, 225 and 550, 225 and 556, 225 and 590, 304 and 323, 304 and 383, 304 and 487, 304 and 556, 304 and 564, 304 and 590, 323 and 357, 323 and 487, 323 and 556, 323 and 564, 323 and 590, 349 and 383, 349 and 590, 357 and 383, 357 and 590, 383 and 487, 383 and 550, 383 and 556, 383 and 564, 383 and 590, 383 and 712, 487 and 564, 487 and 590, 550 and 590, 556 and 564, 556 and 590, 564 and 590, 564 and 712, 590 and 712, and 705 and 712, and preferably the pair of two amino acid positions is selected from the group consisting of I118 and P383, I118 and S556, I118 and T564, I118 and D590, N225 and A304, N225 and P383, N225 and Q487, N225 and V550, N225 and S556, N225 and D590, A304 and T323, A304 and P383, A304 and Q487, A304 and S556, A304 and T564, A304 and D590, T323 and G357, T323 and Q487, T323 and S556, T323 and T564, T323 and D590, F349 and P383, F349 and D590, G357 and P383, G357 and D590, P383 and Q487, P383 and V550, P383 and S556, P383 and T564, P383 and D590, P383 and L712, Q487 and T564, Q487 and D590, V550 and D590, S556 and T564, S556 and D590, T564 and D590, T564 and L712, D590 and L712, and K705 and L712.

In a 31$^{st}$ embodiment of the first aspect which is also an embodiment of the 29$^{th}$ embodiment of the first aspect, the pair of two amino acid positions is selected from the group consisting of 114 and 118, 114 and 383, 114 and 712, 118 and 383, 118 and 556, 118 and 590, 118 and 712, 225 and 304, 225 and 383, 225 and 550, 225 and 590, 304 and 383, 304 and 556, 304 and 590, 323 and 556, 323 and 590, 323 and 649, 349 and 383, 349 and 590, 357 and 383, 357 and 590, 383 and 487, 383 and 550, 383 and 556, 383 and 564, 383 and 590, 383 and 649, 383 and 712, 556 and 564, 556 and 590, 564 and 590, 564 and 712, 590 and 649, and 590 and 712, and preferably the pair of two amino acid positions is selected from the group consisting of L114 and I118, L114 and P383, L114 and L712, I118 and P383, I118 and S556, I118 and D590, I118 and L712, N225 and A304, N225 and P383, N225 and V550, N225 and D590, A304 and P383, A304 and S556, A304 and D590, T323 and S556, T323 and D590, T323 and A649, F349 and P383, F349 and D590, G357 and P383, G357 and D590, P383 and Q487, P383 and V550, P383 and S556, P383 and T564, P383 and D590, P383 and A649, P383 and L712, S556 and T564, S556 and D590, T564 and D590, T564 and L712, D590 and A649, and D590 and L712.

In another preferred embodiment of the first aspect, which is also an embodiment of any other of the previous embodiments of the first aspect, the pair of two amino acid positions is selected from the group consisting of 114 and 118, 114 and 383, 114 and 712, 118 and 383, 118 and 556, 118 and 590, 118 and 712, 225 and 304, 225 and 383, 225 and 550, 225 and 590, 304 and 383, 304 and 556, 304 and 590, 323 and 556, 323 and 590, 349 and 383, 349 and 590, 357 and 383, 357 and 590, 383 and 487, 383 and 550, 383 and 556, 383 and 564, 383 and 590, 383 and 712, 556 and 564, 556 and 590, 564 and 590, 564 and 712, and 590 and 712, and preferably the pair of two amino acid positions is selected from the group consisting of L114 and I118, L114 and P383, L114 and L712, I118 and P383, I118 and S556, I118 and D590, I118 and L712, N225 and A304, N225 and P383, N225 and V550, N225 and D590, A304 and P383, A304 and S556, A304 and D590, T323 and S556, T323 and D590, F349 and P383, F349 and D590, G357 and P383, G357 and D590, P383 and Q487, P383 and V550, P383 and S556, P383 and T564, P383 and D590, P383 and L712, S556 and T564, S556 and D590, T564 and D590, T564 and L712, and D590 and L712.

In a 32$^{nd}$ embodiment of the first aspect which is also an embodiment of the 29$^{th}$ embodiment of the first aspect, the pair of two amino acid positions is selected from the group consisting of 114 and 118, 114 and 304, 114 and 357, 114 and 383, 114 and 590, 114 and 712, 118 and 304, 118 and 357, 118 and 383, 118 and 556, 118 and 590, 118 and 712, 225 and 383, 304 and 357, 304 and 383, 304 and 590, 304 and 712, 323 and 590, 349 and 383, 349 and 590, 357 and 383, 357 and 590, 357 and 705, 357 and 712, 383 and 487, 383 and 550, 383 and 556, 383 and 564, 383 and 590, 383 and 649, 383 and 712, 556 and 590, 564 and 590, 590 and 649, and 590 and 712, and preferably the pair of two amino acid positions is selected from the group consisting of L114 and I118, L114 and A304, L114 and G357, L114 and P383, L114 and D590, L114 and L712, I118 and A304, I118 and G357, I118 and P383, I118 and S556, I118 and D590, I118 and L712, N225 and P383, A304 and G357, A304 and P383, A304 and D590, A304 and L712, T323 and D590, F349 and P383, F349 and D590, G357 and P383, G357 and D590, G357 and K705, G357 and L712, P383 and Q487, P383 and V550, P383 and S556, P383 and T564, P383 and D590, P383 and A649, P383 and L712, S556 and D590, T564 and D590, D590 and A649, and D590 and L712.

In another preferred embodiment of the first aspect, which is also an embodiment of any other of the previous embodiments of the first aspect, the pair of two amino acid positions is selected from the group consisting of 114 and 118, 114 and 304, 114 and 357, 114 and 383, 114 and 590, 114 and 712, 118 and 304, 118 and 357, 118 and 383, 118 and 556, 118 and 590, 118 and 712, 225 and 383, 304 and 357, 304 and 383, 304 and 590, 304 and 712, 323 and 590, 349 and 383, 349 and 590, 357 and 383, 357 and 590, 357 and 705, 357 and 712, 383 and 487, 383 and 550, 383 and 556, 383 and 564, 383 and 590, 383 and 712, 556 and 590, 564 and 590, and 590 and 712, and preferably the pair of two amino acid positions is selected from the group consisting of L114 and I118, L114 and A304, L114 and G357, L114 and P383, L114 and D590, L114 and L712, I118 and A304, I118 and G357, I118 and P383, I118 and S556, I118 and D590, I118 and L712, N225 and P383, A304 and G357, A304 and P383, A304 and D590, A304 and L712, T323 and D590, F349 and P383, F349 and D590, G357 and P383, G357 and D590, G357 and K705, G357 and L712, P383 and Q487, P383 and V550, P383 and S556, P383 and T564, P383 and D590, P383 and L712, S556 and D590, T564 and D590, and D590 and L712.

In another preferred embodiment of the first aspect, which is also an embodiment of any other of the previous embodiments of the first aspect, the pair of two amino acid positions is selected from the group consisting of 118 and 383, 118 and 590, 225 and 383, 225 and 590, 304 and 383, 304 and 590, 323 and 590, 349 and 383, 349 and 590, 357 and 383, 357 and 590, 383 and 487, 383 and 550, 383 and 556, 383 and 564, 383 and 590, 383 and 649, 383 and 712, 487 and 590, 550 and 590, 556 and 590, 564 and 590, 590 and 649, 590 and 712 and preferably the pair of two amino acid positions is selected from the group consisting of I118 and P383, I118 and D590, N225 and P383, N225 and D590, A304 and P383, A304 and D590, T323 and D590, F349 and P383, F349 and D590, G357 and P383, G357 and D590, P383 and Q487, P383 and V550, P383 and S556, P383 and T564, P383 and D590, P383 and A649, P383 and L712, Q487 and D590, V550 and D590, S556 and D590, T564 and D590, D590 and A649, D590 and L712.

In a 33$^{rd}$ embodiment of the first aspect which is also an embodiment of the seventh, eighth, ninth, tenth, eleventh, twelfth, 13$^{th}$, 14$^{th}$, 15$^{th}$, 16$^{th}$, 17$^{th}$, 18$^{th}$, 19$^{th}$, 20$^{th}$, 21$^{st}$, 22$^{nd}$, 23$^{rd}$, 24$^{th}$, 25$^{th}$, 26$^{th}$, 27$^{th}$, 28$^{th}$, 29$^{th}$, 30$^{th}$, 31$^{st}$ and 32$^{nd}$ embodiment or of any other of the previous embodiments of the first aspect, preferably of the 26$^{th}$, 27$^{th}$, 28$^{th}$, 29$^{th}$, 30$^{th}$, 31$^{st}$ and 32$^{nd}$ embodiment or of any other of the previous embodiments of the first aspect, in addition to the substitution at the two amino acid positions, the amino acid sequence of the trehalose phosphorylase comprises an amino acid substitution at at least one or more additional amino acid positions, wherein the one or more additional amino acid position is selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1, preferably, in addition to the substitution at the two amino acid positions, the amino acid sequence of the trehalose phosphorylase comprises an amino acid substitution at at least one or more additional amino acid positions, wherein the one or more additional amino acid position is independently and individually selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1.

In a 34$^{th}$ embodiment of the first aspect which is also an embodiment of the 33$^{rd}$ embodiment of the first aspect, the one or more additional amino acid position is selected from the group consisting of amino acid positions L712, P383, V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705 of SEQ ID NO: 1, preferably the one or more additional amino acid position is independently and individually selected from the group consisting of amino acid positions L712, P383, V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705 of SEQ ID NO:1.

In a 35$^{th}$ embodiment of the first aspect which is also an embodiment of the 33$^{rd}$ embodiment of the first aspect, the one or more additional amino acid position is selected from the group consisting of amino acid positions 712, 383, 10, 114, 118, 220, 225, 304, 318, 323, 349, 357, 481, 487, 488, 506, 511, 550, 556, 564, 590, 649, 703 and 705 of SEQ ID NO: 1, preferably the one or more additional amino acid position is independently and individually selected from the group consisting of amino acid positions 712, 383, 10, 114, 118, 220, 225, 304, 318, 323, 349, 357, 481, 487, 488, 506, 511, 550, 556, 564, 590, 649, 703 and 705 of SEQ ID NO: 1.

In a 36$^{th}$ embodiment of the first aspect which is also an embodiment of the 35$^{th}$ embodiment of the first aspect, the one or more additional amino acid position is selected from the group consisting of amino acid positions L712, P383, V10, L114, I118, Y220, N225, A304, P318, T323, F349, G357, E481, Q487, K488, A506, A511, V550, S556, T564, D590, A649, A703 and K705, of SEQ ID NO:1, preferably the one or more additional amino acid position is independently and individually selected from the group consisting of amino acid positions L712, P383, V10, L114, I118, Y220, N225, A304, P318, T323, F349, G357, E481, Q487, K488, A506, A511, V550, S556, T564, D590, A649, A703 and K705 of SEQ ID NO: 1.

In a 37$^{th}$ embodiment of the first aspect which is also an embodiment of the 33$^{rd}$ embodiment of the first aspect, the one or more additional amino acid position is selected from the group consisting of amino acid positions 712, 383, 10, 114, 118, 225, 304, 323, 349, 357, 487, 550, 556, 564, 590 and 649 of SEQ ID NO:1, preferably the one or more additional amino acid position is independently and individually selected from the group consisting of amino acid positions 712, 383, 10, 114, 118, 225, 304, 323, 349, 357, 487, 550, 556, 564, 590 and 649 of SEQ ID NO:1.

In a 38$^{th}$ embodiment of the first aspect which is also an embodiment of the 37$^{th}$ embodiment of the first aspect, the one or more additional amino acid position is selected from the group consisting of amino acid positions L712, P383, V10, L114, I118, N225, A304, T323, F349, G357, Q487, V550, S556, T564, D590 and A649 of SEQ ID NO: 1, preferably the one or more additional amino acid position is independently and individually selected from the group consisting of amino acid positions L712, P383, V10, L114, I118, N225, A304, T323, F349, G357, Q487, V550, S556, T564, D590 and A649 of SEQ ID NO:1.

In a 39$^{th}$ embodiment of the first aspect which is also an embodiment of the 33$^{rd}$ embodiment of the first aspect, wherein the one or more additional amino acid position is selected from the group consisting of amino acid positions 712, 383, 114, 118, 225, 304, 323, 349, 357, 487, 550, 556, 564, 590 and 649 of SEQ ID NO: 1, preferably the one or more additional amino acid position is independently and individually selected from the group consisting of amino acid positions 712, 383, 114, 118, 225, 304, 323, 349, 357, 487, 550, 556, 564, 590 and 649 of SEQ ID NO: 1.

In a 40$^{th}$ embodiment of the first aspect which is also an embodiment of the 39$^{th}$ embodiment of the first aspect, the one or more additional amino acid position is selected from the group consisting of amino acid positions L712, P383, L114, I118, N225, A304, T323, F349, G357, Q487, V550, S556, T564, D590 and A649 of SEQ ID NO: 1, preferably the one or more additional amino acid position is independently and individually selected from the group consisting of amino acid positions L712, P383, L114, I118, N225, A304, T323, F349, G357, Q487, V550, S556, T564, D590 and A649 of SEQ ID NO: 1.

In a 41$^{st}$ embodiment of the first aspect which is also an embodiment of the 33$^{rd}$ embodiment of the first aspect, the one or more additional amino acid position selected from the group consisting of amino acid positions 712, 383, 114, 118, 225, 304, 357, 487, 556, and 590 of SEQ ID NO: 1, preferably the one or more additional amino acid position is independently and individually selected from the group consisting of amino acid positions 712, 383, 114, 118, 225, 304, 357, 487, 556, and 590 of SEQ ID NO: 1.

In a 42$^{nd}$ embodiment of the first aspect which is also an embodiment of the 41$^{st}$ embodiment of the first aspect, the one or more additional amino acid position is selected from the group consisting of amino acid positions L712, P383, L114, I118, N225, A304, G357, Q487, S556, and D590 of SEQ ID NO: 1, preferably the one or more additional amino acid position is independently and individually selected from the group consisting of amino acid positions L712, P383, L114, I118, N225, A304, G357, Q487, S556, and D590 of SEQ ID NO: 1.

In another preferred embodiment of the first aspect, which is also an embodiment of any other of the previous embodiments of the first aspect, the amino acid sequence of the trehalose phosphorylase comprises an amino acid substitution at amino acid positions 383, and 590 of SEQ ID NO: 1, preferably at amino acid positions P383, and D590 of SEQ ID NO: 1, and wherein the amino acid sequence of the trehalose phosphorylase comprises further amino acid substitutions at the following amino acid positions of SEQ ID NO: 1

(i) 114, 118, 304, 357, and 712, preferably L114, I118, A304, G357, and L712, or (ii) 114, 118, 304, 357, 550, 556, and 712, preferably L114, I118, A304, G357, V550, S556, and L712, or (iii) 114, 118, 225, 304, 357, 487, 564, and 712, preferably L114, I118, N225, A304, G357, Q487, T564, and L712, or (iv) 114, 118, 304, 323, 357, 550, 564, and 712, preferably L114, I118, A304, T323, G357, V550, T564, and L712, or (v) 114, 118, 225, 304, 323, 357, 487, and 712, preferably L114, I118, N225, A304, T323, G357, Q487, and L712, or (vi) 114, 118, 225, 304, 357, 487, 550, 556, and 712, preferably L114, I118, N225, A304, G357, Q487, V550, S556, and L712, or (vii) 114, 118, 225, 304, 357, 487, 550, 564, and 712, preferably L114, I118, N225, A304, G357, Q487, V550, T564, and L712, or (viii) 114, 118, 225, 304, 357, 550, 556, 564, and 712, preferably L114, I118, N225, A304, G357, V550, S556, T564, and L712, or (ix) 114, 118, 225, 304, 357, 550, 564, and 712, preferably L114, I118, N225, A304, G357, V550, T564, and L712, or (x) 114, 118, 304, 323, 357, 550, 556, 564, and 712, preferably L114, I118, A304, T323, G357, V550, S556, T564, and L712, or (xi) 114, 118, 304, 323, 357, 487, 550, 649, and 712, preferably L114, I118, A304, T323, G357, Q487, V550, A649, and L712, or (xii) 114, 118, 225, 304, 357, 487, 550, 556, 564, and 712, preferably L114, I118, N225, A304, G357, Q487, V550, S556, T564, and L712, or (xiii) 114, 118, 225, 304, 357, 550, 556, 564, 649, and 712, preferably L114, I118, N225, A304, G357, V550, S556, T564, A649, and L712, or (xiv) 114, 118, 225, 304, 323, 357, 487, 550, 564, and 712, preferably L114, I118, N225, A304, T323, G357, Q487, V550, T564, and L712, or (xv) 114, 118, 225, 304, 323, 357, 487, 550, 649, and 712, preferably L114, I118, N225, A304, T323, G357, Q487, V550, A649, and L712, or (xvi) 114, 118, 225, 304, 323, 357, 487, 550, 556, and 712, preferably L114, I118, N225, A304, T323, G357, Q487, V550, S556, and L712, or (xvii) 114, 118, 225, 304, 323, 357, 550, 556, 564, and 712, preferably L114, I118, N225, A304, T323, G357, V550, S556, T564, and L712, or (xviii) 114, 118, 304, 323, 349, 357, 487, 550, 649, and 712, preferably L114, I118, A304, T323, F349, G357, Q487, V550, A649, and L712, or (xix) 114, 118, 304, 323, 357, 487, 550, 556, 564, and 712, preferably L114, I118, A304, T323, G357, Q487, V550, S556, T564, and L712, or (xx) 114, 118, 304, 357, 487, 550, 556, 564, 649, and 712, preferably L114, I118, A304, G357, Q487, V550, S556, T564, A649, and L712, or (xxi) 114, 118, 225, 304, 323, 349, 357, 550, 556, 649, and 712, preferably L114, I118, N225, A304, T323, F349, G357, V550, S556, A649, and L712, or (xxii) 114, 118, 225, 304, 323, 357, 487, 550, 556, 649, and 712, preferably L114, I118, N225, A304, T323, G357, Q487, V550, S556, A649, and L712, or (xxiii) 114, 118, 225, 304, 349, 357, 487, 550, 556, 564, and 712, preferably L114, I118, N225, A304, F349, G357, Q487, V550, S556, T564, and L712, or (xxiv) 114, 118, 225, 304, 349, 357, 487, 550, 564, 649, and 712, preferably L114, I118, N225, A304, F349, G357, Q487, V550, T564, A649, and L712, or (xxv) 114, 118, 225, 304, 323, 349, 357, 487, 550, 556, 564, 649, and 712, preferably L114, I118, N225, A304, T323, F349, G357, Q487, V550, S556, T564, A649, and L712, or (xxvi) 114, 118, 225, 304, 357, 487, 550, 556, 564, 649, and 712, preferably L114, I118, N225, A304, G357, Q487, V550, S556, T564, A649, and L712, or (xxvii) 114, 118, 304, 323, 357, 487, 550, 556, 564, 649, and 712, preferably L114, I118, A304, T323, G357, Q487, V550, S556, T564, A649, and L712, or (xxviii) 114, 118, 225, 304, 323, 357, 487, 550, 556, 564, 649, and 712, preferably L114, I118, N225, A304, T323, G357, Q487, V550, S556, T564, A649, and L712, or (xxix) 114, 118, 225, 304, 323, 349, 357, 487, 550, 556, 564, 649, and 712, preferably L114, I118, N225, A304, T323, F349, G357, Q487, V550, S556, T564, A649, and L712, or (xxx) 114, 225, 304, 323, 357, 487, 550, 556, 564, 649, and 712, preferably L114, N225, A304, T323, G357, Q487, V550, S556, T564, A649, and L712, or (xxxi) 114, 118, 225, 323, 357, 487, 550, 556, 564, 649, and 712, preferably L114, I118, N225, T323, G357, Q487, V550, S556, T564, A649, and L712, or (xxxii) 114, 118, 225, 304, 323, 349, 487, 550, 556, 564, 649, and 712, preferably L114, I118, N225, A304, T323, F349, Q487, V550, S556, T564, A649, and L712, or (xxxiii) 114, 118, 225, 304, 323, 349, 357, 487, 550, 556, 564, and 649, preferably L114, I118, N225, A304, T323, F349, G357, Q487, V550, S556, T564, and A649.

In another preferred embodiment of the first aspect, which is also an embodiment of any other of the previous embodiments of the first aspect, the amino acid sequence of the trehalose phosphorylase comprises one or more additional amino acid substitution at amino acid positions selected from the group consisting of positions 712, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 649, 667, 703 and 705 of SEQ ID NO: 1, preferably selected from the group consisting of positions L712, V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, A649, R667, A703 and K705 of SEQ ID NO: 1.

In another preferred embodiment of the first aspect, which is also an embodiment of any other of the previous embodiments of the first aspect, the amino acid sequence of the trehalose phosphorylase comprises an amino acid substitution at three amino acid positions of SEQ ID NO: 1, preferably at four amino acid positions of SEQ ID NO: 1, more preferably at five amino acid positions of SEQ ID NO: 1, and most preferably at six amino acid positions of SEQ ID NO: 1, wherein each and any of the amino acid positions of SEQ ID NO: 1 is selected from the group consisting of 712, 383, 114, 118, 225, 304, 357, 487, 556, and 590.

In another preferred embodiment of the first aspect, which is also an embodiment of any other of the previous embodiments of the first aspect, the amino acid sequence of the trehalose phosphorylase comprises an amino acid substitution at three amino acid positions of SEQ ID NO: 1, preferably at four amino acid positions of SEQ ID NO: 1, more preferably at five amino acid positions of SEQ ID NO: 1, and most preferably at six amino acid positions of SEQ ID NO: 1, wherein each and any of the amino acid positions of SEQ ID NO: 1 is selected from the group consisting of L712, P383, L114, I118, N225, A304, G357, Q487, S556, and D590.

In a 43$^{rd}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$, 18$^{th}$, 19$^{th}$, 20$^{th}$, 21$^{st}$, 22$^{nd}$, 23$^{rd}$, 24$^{th}$, 25$^{th}$, 26$^{th}$, 27$^{th}$, 28$^{th}$, 29$^{th}$, 30$^{th}$, 31$^{st}$, 32$^{nd}$, 33$^{rd}$, 34$^{th}$, 35$^{th}$, 36$^{th}$, 37$^{th}$, 38$^{th}$, 29$^{th}$, 40$^{th}$, 41$^{st}$ and 42$^{nd}$ embodiment or of any other of the previous embodiments of the first aspect, preferably of the 26$^{th}$, 27$^{th}$, 28$^{th}$, 29$^{th}$, 30$^{th}$, 31$^{st}$, 32$^{nd}$, 33$^{rd}$, 34$^{th}$, 35$^{th}$, 36$^{th}$, 37$^{th}$, 38$^{th}$, 29$^{th}$, 40$^{th}$, 41$^{st}$ and 42$^{nd}$ embodiment or of any other of the previous embodiments of the first aspect, more preferably of the 29$^{th}$, 30$^{th}$, 31$^{st}$, 32$^{nd}$, 33$^{rd}$, 34$^{th}$, 35$^{th}$, 36$^{th}$, 37$^{th}$, 38$^{th}$, 29$^{th}$, 40$^{th}$, 41$^{st}$ and 42$^{nd}$ embodiment or of any other of the previous embodiments of the first aspect, the amino acid sequence of the trehalose phosphorylase comprises an amino acid substitution at three amino acid positions of SEQ ID NO: 1, preferably at four amino acid positions of SEQ ID NO: 1, more preferably at five amino acid positions of SEQ ID NO: 1, and most preferably at six amino acid positions of SEQ ID NO: 1, wherein each and any of the amino acid positions of SEQ ID NO: 1 is selected from the group consisting of 712, 383, 114, 118, 304 and 357.

In a 44th embodiment of the first aspect which is also an embodiment of the 43rd embodiment of the first aspect, the amino acid sequence of the trehalose phosphorylase comprises an amino acid substitution at three amino acid positions of SEQ ID NO: 1, preferably at four amino acid positions of SEQ ID NO: 1, more preferably at five amino acid positions of SEQ ID NO: 1, and most preferably at six amino acid positions of SEQ ID NO: 1, wherein each and any of the amino acid positions of SEQ ID NO: 1 is selected from the group consisting of L712, P383, L114, I118, A304 and G357.

In a 45th embodiment of the first aspect which is also an embodiment of the 43rd and 44th embodiment of the first aspect, the amino acid sequence of the trehalose phosphorylase comprises an amino acid substitution at four amino acid positions of SEQ ID NO: 1, wherein each and any of the amino acid positions of SEQ ID NO: 1 is selected from the group consisting of 712, 383, 114, 118, 304 and 357.

In a 46th embodiment of the first aspect which is also an embodiment of the 43rd and 44th embodiment of the first aspect, the amino acid sequence of the trehalose phosphorylase comprises an amino acid substitution at four amino acid positions of SEQ ID NO: 1, wherein each and any of the amino acid positions of SEQ ID NO: 1 is selected from the group consisting of L712, P383, L114, I118, A304 and G357.

In a 47th embodiment of the first aspect which is also an embodiment of the 43rd, 44th, 45th and 46th embodiment of the first aspect, the amino acid sequence of the trehalose phosphorylase comprises an amino acid substitution at five amino acid positions of SEQ ID NO: 1, wherein each and any of the amino acid positions of SEQ ID NO: 1 is selected from the group consisting of 712, 383, 114, 118, 304 and 357.

In a 48th embodiment of the first aspect which is also an embodiment of the 43rd, 44th, 45th and 46th embodiment of the first aspect, the amino acid sequence of the trehalose phosphorylase comprises an amino acid substitution at five amino acid positions of SEQ ID NO: 1, wherein each and any of the amino acid positions of SEQ ID NO: 1 is selected from the group consisting of L712, P383, L114, I118, A304 and G357.

In a 49th embodiment of the first aspect which is also an embodiment of the 43rd, 44th, 45th, 46th, 47th and 48th embodiment of the first aspect, the amino acid sequence of the trehalose phosphorylase comprises an amino acid substitution at six amino acid positions of SEQ ID NO: 1, wherein each and any of the amino acid positions of SEQ ID NO: 1 is selected from the group consisting of 712, 383, 114, 118, 304 and 357.

In a 50th embodiment of the first aspect which is also an embodiment of the 43rd, 44th, 45th, 46th, 47th and 48th embodiment of the first aspect, the amino acid sequence of the trehalose phosphorylase comprises an amino acid substitution at six amino acid positions of SEQ ID NO: 1, wherein each and any of the amino acid positions of SEQ ID NO: 1 is selected from the group consisting of L712, P383, L114, I118, A304 and G357.

In another preferred embodiment of the first aspect, which is also an embodiment of any other of the previous embodiments of the first aspect, the amino acid sequence of the trehalose phosphorylase comprises an amino acid substitution at three amino acid positions of SEQ ID NO: 1, preferably at four amino acid positions of SEQ ID NO: 1, more preferably at five amino acid positions of SEQ ID NO: 1, and most preferably at six amino acid positions of SEQ ID NO: 1, wherein each and any of the amino acid positions of SEQ ID NO: 1 is selected from the group consisting of 712, 383, 118, 225, 304, 349, 357, 487, 556, 564, and 590.

In another preferred embodiment of the first aspect, which is also an embodiment of any other of the previous embodiments of the first aspect, the amino acid sequence of the trehalose phosphorylase comprises an amino acid substitution at three amino acid positions of SEQ ID NO: 1, preferably at four amino acid positions of SEQ ID NO: 1, more preferably at five amino acid positions of SEQ ID NO: 1, and most preferably at six amino acid positions of SEQ ID NO: 1, wherein each and any of the amino acid positions of SEQ ID NO: 1 is selected from the group consisting of 712, 383, 225, 304, 349, 556, and 590.

In another preferred embodiment of the first aspect, which is also an embodiment of any other of the previous embodiments of the first aspect, the amino acid sequence of the trehalose phosphorylase comprises an amino acid substitution at three amino acid positions of SEQ ID NO: 1, preferably at four amino acid positions of SEQ ID NO: 1, more preferably at five amino acid positions of SEQ ID NO: 1, wherein each and any of the amino acid positions of SEQ ID NO: 1 is selected from the group consisting of 383, 225, 304, 556, and 590.

In another preferred embodiment of the first aspect, which is also an embodiment of any other of the previous embodiments of the first aspect, the amino acid sequence of the trehalose phosphorylase comprises an amino acid substitution at three amino acid positions of SEQ ID NO: 1, wherein each and any of the amino acid positions of SEQ ID NO: 1 is selected from the group consisting of 383, 556, and 590.

In another preferred embodiment of the first aspect, which is also an embodiment of any other of the previous embodiments of the first aspect, the amino acid sequence of the trehalose phosphorylase comprises an amino acid substitution at three amino acid positions of SEQ ID NO: 1, preferably at four amino acid positions of SEQ ID NO: 1, more preferably at five amino acid positions of SEQ ID NO: 1, and most preferably at six amino acid positions of SEQ ID NO: 1, wherein each and any of the amino acid positions of SEQ ID NO: 1 is selected from the group consisting of L712, P383, I118, N225, A304, F349, G357, Q487, S556, T564, and D590.

In a 51st embodiment of the first aspect which is also an embodiment of the 33rd, 34th, 35th, 36th, 37th, 38th, 29th, 40th, 41st, 42nd, 43rd, 44th, 45th, 46th, 47th, 48th, 49th and 50th embodiment or of any other of the previous embodiments of the first aspect, the amino acid sequence of the trehalose phosphorylase comprises
  (a) an amino acid substitution at the four amino acid positions 712, 383, 114 and 118 of SEQ ID NO: 1, and/or 383, 487, 556, and 590 of SEQ ID NO: 1; and/or 383, 225, 556, and 590 of SEQ ID NO: 1; or
  (b) an amino acid substitution at the five amino acid positions 712, 383, 114, 118 and 304 of SEQ ID NO: 1; and/or 712, 383, 114, 118 and 357 of SEQ ID NO: 1; and/or 383, 225, 304, 556, and 590 of SEQ ID NO: 1; and/or 383, 225, 487, 556, and 590 of SEQ ID NO: 1; or
  (c) an amino acid substitution at the six amino acid positions 712, 383, 114, 118, 304 and 357 of SEQ ID NO: 1; and/or 383, 225, 304, 487, 556, and 590 of SEQ ID NO: 1; or
  (d) an amino acid substitution at the three amino acid positions 383, 556, and 590 of SEQ ID NO: 1.

In a 52$^{nd}$ embodiment of the first aspect which is also an embodiment of the 33$^{rd}$, 34$^{th}$, 35$^{th}$, 36$^{th}$, 37$^{th}$, 38$^{th}$, 39$^{th}$, 40$^{th}$, 41$^{st}$, 42$^{nd}$, 43$^{rd}$, 44$^{th}$, 45$^{th}$, 46$^{th}$, 47$^{th}$, 48$^{th}$, 49$^{th}$ and 50$^{th}$ embodiment or of any other of the previous embodiments of the first aspect, the amino acid sequence of the trehalose phosphorylase comprises (a) an amino acid substitution at the four amino acid positions 712, 383, 114 and 118 of SEQ ID NO: 1; and/or 383, 487, 556, and 590 of SEQ ID NO: 1; and/or 383, 225, 556, and 590 of SEQ ID NO: 1, and preferably at the four amino acid positions L712, P383, L114 and I118 of SEQ ID NO: 1; and/or P383, Q487, S556, and D590 of SEQ ID NO: 1; and/or P383, N225, S556, and D590 of SEQ ID NO: 1; or (b) an amino acid substitution at the five amino acid positions 712, 383, 114, I118 and 304 of SEQ ID NO: 1; and/or 712, 383, 114, 118 and 357 of SEQ ID NO: 1; and/or 383, 225, 304, 556, and 590 of SEQ ID NO: 1; and/or 383, 225, 487, 556, and 590 of SEQ ID NO: 1, preferably at five amino acid positions L712, P383, L114, I118 and A304 of SEQ ID NO: 1; and/or L712, P383, L114, I118 and G357 of SEQ ID NO: 1; and/or P383, N225, A304, S556, and D590 of SEQ ID NO: 1; and/or P383, N225, Q487, S556, and D590 of SEQ ID NO: 1; or (c) an amino acid substitution 712, 383, 114, 118, 304 and 357 of SEQ ID NO: 1; and/or 383, 225, 304, 487, 556, and 590 of SEQ ID NO: 1, preferably at the six amino acid positions L712, P383, L114, I118, A304 and G357 of SEQ ID NO: 1; and/or P383, N225, A304, Q487, S556, and D590 of SEQ ID NO: 1, or (d) an amino acid substitution at the three amino acid positions 383, 556, and 590, preferably at the three amino acid positions P383, S556, and D590 of SEQ ID NO: 1.

In a 53$^{rd}$ embodiment of the first aspect which is also an embodiment of the 43$^{rd}$, 44$^{th}$, 45$^{th}$, 46$^{th}$, 47$^{th}$, 48$^{th}$, 49$^{th}$, 50$^{th}$, 51$^{st}$ and 52$^{nd}$ embodiment or of any other of the previous embodiments of the first aspect, the amino acid sequence of the trehalose phosphorylase comprises an amino acid sequence of SEQ ID NO: 14.

In a 54$^{th}$ embodiment of the first aspect which is also an embodiment of the 43$^{rd}$, 44$^{th}$, 45$^{th}$, 46$^{th}$, 47$^{th}$, 48$^{th}$, 49$^{th}$, 50$^{th}$, 51$^{st}$ and 52$^{nd}$ embodiment or of any other of the previous embodiments of the first aspect, the amino acid sequence of the trehalose phosphorylase consists of an amino acid sequence of SEQ ID NO: 14.

In another preferred embodiment of the first aspect, which is also an embodiment of any other of the previous embodiments of the first aspect, the amino acid sequence of the trehalose phosphorylase comprises an amino acid substitution at one or more further amino acid positions, wherein the one or more further amino acid positions are independently and individually selected from the group consisting of amino acid positions 10, 114, 118, 192, 197, 220, 225, 304, 306, 318, 323, 339, 349, 357, 383, 459, 476, 481, 484, 487, 488, 506, 511, 526, 530, 532, 533, 537, 550, 556, 564, 590, 649, 667, 703, 705 and 712 of SEQ ID NO: 1.

In another preferred embodiment of this aspect, which is also an embodiment of any other of the previous embodiments of the first aspect, the one or more further amino acid positions are independently and individually selected from the group consisting of amino acid positions V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703, K705, and L712 of SEQ ID NO: 1.

In a 55$^{th}$ embodiment of the first aspect which is also an embodiment of the 43$^{rd}$, 44$^{th}$, 45$^{th}$, 46$^{th}$, 47$^{th}$, 48$^{th}$, 49$^{th}$, 50$^{th}$, 51$^{st}$, 52$^{nd}$, 53$^{rd}$ and 54$^{th}$ embodiment or of any other of the previous embodiments of the first aspect, the amino acid sequence of the trehalose phosphorylase comprises an amino acid substitution at one or more further amino acid positions, wherein the one or more further amino acid positions are selected from the group consisting of amino acid positions 10, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1, preferably the one or more further amino acid positions are independently and individually selected from the group consisting of amino acid positions 10, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1.

In a 56$^{th}$ embodiment of the first aspect which is also an embodiment of the 55$^{th}$ embodiment of the first aspect, the one or more further amino acid positions are selected from the group consisting of amino acid positions V10, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705 of SEQ ID NO: 1, preferably the one or more further amino acid positions are independently and individually selected from the group consisting of amino acid positions V10, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705 of SEQ ID NO: 1.

In a 57$^{th}$ embodiment of the first aspect which is also an embodiment of the 55$^{th}$ embodiment of the first aspect, the one or more further amino acid positions are selected from the group consisting of amino acid positions 10, 220, 225, 304, 318, 323, 349, 357, 481, 487, 488, 506, 511, 550, 556, 564, 590, 649, 703 and 705 of SEQ ID NO: 1, preferably the one or more further amino acid positions are independently and individually selected from the group consisting of amino acid positions 10, 220, 225, 304, 318, 323, 349, 357, 481, 487, 488, 506, 511, 550, 556, 564, 590, 649, 703 and 705 of SEQ ID NO: 1.

In a 58$^{th}$ embodiment of the first aspect which is also an embodiment of the 57$^{th}$ embodiment of the first aspect, the one or more further amino acid positions are selected from the group consisting of amino acid positions V10, Y220, N225, A304, P318, T323, F349, G357, E481, Q487, K488, A506, A511, V550, S556, T564, D590, A649, A703 and K705 of SEQ ID NO: 1, preferably the one or more further amino acid positions are independently and individually selected from the group consisting of amino acid positions V10, Y220, N225, A304, P318, T323, F349, G357, E481, Q487, K488, A506, A511, V550, S556, T564, D590, A649, A703 and K705 of SEQ ID NO: 1.

In a 59$^{th}$ embodiment of the first aspect which is also an embodiment of the 55$^{th}$ embodiment of the first aspect, the one or more further amino acid positions are selected from the group consisting of amino acid positions 10, 225, 304, 323, 349, 357, 487, 550, 556, 564, 590 and 649 of SEQ ID NO: 1, preferably the one or more further amino acid positions are independently and individually selected from the group consisting of amino acid positions 10, 225, 304, 323, 349, 357, 487, 550, 556, 564, 590 and 649 of SEQ ID NO: 1.

In a 60$^{th}$ embodiment of the first aspect which is also an embodiment of the 59$^{th}$ embodiment of the first aspect, the one or more further amino acid positions are selected from the group consisting of amino acid positions V10, N225, A304, T323, F349, G357, Q487, V550, S556, T564, D590 and A649 of SEQ ID NO: 1, preferably the one or more further amino acid positions are independently and individually selected from the group consisting of amino acid positions V10, N225, A304, T323, F349, G357, Q487, V550, S556, T564, D590 and A649 of SEQ ID NO: 1.

In a 61$^{st}$ embodiment of the first aspect which is also an embodiment of the 55$^{th}$ embodiment of the first aspect, wherein the one or more further amino acid positions are selected from the group consisting of amino acid positions 225, 304, 323, 349, 357, 487, 550, 556, 564, 590 and 649 of SEQ ID NO: 1, preferably the one or more further amino acid positions are independently and individually selected from the group consisting of amino acid positions 225, 304, 323, 349, 357, 487, 550, 556, 564, 590 and 649 of SEQ ID NO: 1.

In a 62$^{nd}$ embodiment of the first aspect which is also an embodiment of the 61$^{st}$ embodiment of the first aspect, the one or more further amino acid positions are selected from the group consisting of amino acid positions N225, A304, T323, F349, G357, Q487, V550, S556, T564, D590 and A649 of SEQ ID NO: 1, preferably the one or more further amino acid positions are independently and individually selected from the group consisting of amino acid positions N225, A304, T323, F349, G357, Q487, V550, S556, T564, D590 and A649 of SEQ ID NO: 1.

In a 63$^{rd}$ embodiment of the first aspect which is also an embodiment of the 55$^{th}$ embodiment of the first aspect, wherein the one or more further amino acid positions are selected from the group consisting of amino acid positions 304, 357 and 590 of SEQ ID NO: 1, preferably wherein the one or more further amino acid positions are independently and individually selected from the group consisting of amino acid positions 304, 357 and 590 of SEQ ID NO: 1.

In a 64$^{th}$ embodiment of the first aspect which is also an embodiment of the 63$^{rd}$ embodiment of the first aspect, the one or more further amino acid positions are selected from the group consisting of amino acid positions A304, G357 and D590 of SEQ ID NO: 1, preferably the one or more further amino acid positions are independently and individually selected from the group consisting of amino acid positions A304, G357 and D590 of SEQ ID NO: 1.

In a 65$^{th}$ embodiment of the first aspect which is also an embodiment of the 55$^{th}$, 56$^{th}$, 57$^{th}$, 58$^{th}$, 59$^{th}$, 60$^{th}$, 61$^{st}$, 62$^{nd}$, 63$^{rd}$ and 64$^{th}$ embodiment or of any other of the previous embodiments of the first aspect, the amino acid sequence of the trehalose phosphorylase comprises an amino acid sequence according to SEQ ID NO: 44.

In a 66$^{th}$ embodiment of the first aspect which is also an embodiment of the 65$^{th}$ embodiment of the first aspect, the amino acid sequence of the trehalose phosphorylase consists of an amino acid sequence according to SEQ ID NO: 44.

In another preferred embodiment of the first aspect, which is also an embodiment of any other of the previous embodiments of the first aspect, the amino acid sequence of the trehalose phosphorylase comprises an amino acid substitution at one or more still further amino acid positions, wherein the one or more still further amino acid positions are individually and independently selected from the group consisting of amino acid positions 10, 114, 118, 192, 197, 220, 225, 304, 306, 318, 323, 339, 349, 357, 383, 459, 476, 481, 484, 487, 488, 506, 511, 526, 530, 532, 533, 537, 550, 556, 564, 590, 649, 667, 703, 705 and 712 of SEQ ID NO: 1.

In another preferred embodiment of the first aspect, which is also an embodiment of any other of the previous embodiments of the first aspect, the amino acid sequence of the trehalose phosphorylase comprises an amino acid substitution at one or more still further amino acid positions, wherein the one or more still further amino acid positions are individually and independently selected from the group consisting of amino acid positions V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703, K705, and L712 of SEQ ID NO: 1.

In a 67$^{th}$ embodiment of the first aspect which is also an embodiment of the 55$^{th}$, 56$^{th}$, 57$^{th}$, 58$^{th}$, 59$^{th}$, 60$^{th}$, 61$^{st}$, 62$^{nd}$, 63$^{rd}$, 64$^{th}$, 65$^{th}$, and 66$^{th}$ embodiment or of any other of the previous embodiments of the first aspect, the amino acid sequence of the trehalose phosphorylase comprises an amino acid substitution at one or more still further amino acid positions, wherein the one or more still further amino acid positions are selected from the group consisting of amino acid positions 10, 192, 197, 220, 225, 306, 318, 323, 339, 349, 459, 476, 481, 484, 487, 488, 506, 511, 526, 530, 532, 533, 537, 550, 556, 564, 649, 667, 703 and 705 of SEQ ID NO: 1, preferably the amino acid sequence of the trehalose phosphorylase comprises an amino acid substitution at one or more still further amino acid positions, wherein the one or more still further amino acid positions are individually and independently selected from the group consisting of amino acid positions 10, 192, 197, 220, 225, 306, 318, 323, 339, 349, 459, 476, 481, 484, 487, 488, 506, 511, 526, 530, 532, 533, 537, 550, 556, 564, 649, 667, 703 and 705 of SEQ ID NO: 1.

In a 68$^{th}$ embodiment of the first aspect which is also an embodiment of the 67$^{th}$ embodiment of the first aspect, the one or more still further amino acid positions are selected from the group consisting of amino acid positions V10, S192, S197, Y220, N225, D306, P318, T323, L339, F349, A459, Q476, E481, A484, Q487, K488, A506, A511, R526, E530, G532, D533, D537, V550, S556, T564, A649, R667, A703 and K705 of SEQ ID NO: 1, preferably the one or more still further amino acid positions are individually and independently selected from the group consisting of amino acid positions V10, S192, S197, Y220, N225, D306, P318, T323, L339, F349, A459, Q476, E481, A484, Q487, K488, A506, A511, R526, E530, G532, D533, D537, V550, S556, T564, A649, R667, A703 and K705 of SEQ ID NO: 1.

In a 69$^{th}$ embodiment of the first aspect which is also an embodiment of the 67$^{th}$ embodiment of the first aspect, the one or more still further amino acid positions are selected from the group consisting of amino acid positions 10, 220, 225, 318, 323, 349, 481, 487, 488, 506, 511, 550, 556, 564, 649, 703 and 705 of SEQ ID NO: 1, preferably the one or more still further amino acid positions are individually and independently selected from the group consisting of amino acid positions 10, 220, 225, 318, 323, 349, 481, 487, 488, 506, 511, 550, 556, 564, 649, 703 and 705 of SEQ ID NO: 1.

In a 70$^{th}$ embodiment of the first aspect which is also an embodiment of the 69$^{th}$ embodiment of the first aspect, the one or more still further amino acid positions are selected from the group consisting of amino acid positions V10, Y220, N225, P318, T323, F349, E481, Q487, K488, A506, A511, V550, S556, T564, A649, A703 and K705 of SEQ ID NO: 1, preferably the one or more still further amino acid positions are individually and independently selected from the group consisting of amino acid positions V10, Y220, N225, P318, T323, F349, E481, Q487, K488, A506, A511, V550, S556, T564, A649, A703 and K705 of SEQ ID NO: 1.

In a 71$^{st}$ embodiment of the first aspect which is also an embodiment of the 67$^{th}$ embodiment of the first aspect, the one or more still further amino acid positions are selected from the group consisting of amino acid positions 10, 225, 323, 349, 487, 550, 556, 564 and 649 of SEQ ID NO: 1, preferably the one or more still further amino acid positions are individually and independently selected from the group consisting of amino acid positions 10, 225, 323, 349, 487, 550, 556, 564 and 649 of SEQ ID NO: 1.

In a 72$^{nd}$ embodiment of the first aspect which is also an embodiment of the 71$^{st}$ embodiment of the first aspect, the one or more still further amino acid positions are selected from the group consisting of amino acid positions V10, N225, T323, F349, Q487, V550, S556, T564 and A649 of SEQ ID NO: 1, preferably the one or more still further amino acid positions are individually and independently selected from the group consisting of amino acid positions V10, N225, T323, F349, Q487, V550, S556, T564 and A649 of SEQ ID NO: 1.

In a 73$^{rd}$ embodiment of the first aspect which is also an embodiment of the 67$^{th}$ embodiment of the first aspect, the one or more still further amino acid positions are selected from the group consisting of amino acid positions 225, 323, 349, 487, 550, 556, 564 and 649 of SEQ ID NO: 1, preferably the one or more still further amino acid positions are individually and independently selected from the group consisting of amino acid positions 225, 323, 349, 487, 550, 556, 564 and 649 of SEQ ID NO: 1.

In a 74$^{th}$ embodiment of the first aspect which is also an embodiment of the 73$^{rd}$ embodiment of the first aspect, the one or more still further amino acid positions are selected from the group consisting of amino acid positions N225, T323, F349, Q487, V550, S556, T564 and A649 of SEQ ID NO: 1, preferably the one or more still further amino acid positions are individually and independently selected from the group consisting of amino acid positions N225, T323, F349, Q487, V550, S556, T564 and A649 of SEQ ID NO: 1.

In a 75$^{th}$ embodiment of the first aspect which is also an embodiment of the 67$^{th}$, 68$^{th}$, 69$^{th}$, 70$^{th}$, 71$^{st}$, 72$^{nd}$, 73$^{rd}$ and 74$^{th}$ embodiment or of any other of the previous embodiments of the first aspect, the amino acid sequence of the trehalose phosphorylase comprises an amino acid substitution at amino acid positions 712, 383, 114, 118, 304, 357 and 590 of SEQ ID NO: 1, preferably at amino acid positions L712, P383, L114, I118, A304, G357 and D590 of SEQ ID NO: 1, and the amino acid sequence of the trehalose phosphorylase comprises further amino acid substitutions at the following amino acid positions of SEQ ID NO: 1

(i) 550 and 556, preferably V550 and S556, or
(ii) 225, 487 and 564, preferably N225, Q487 and T564, or
(iii) 323, 550 and 564, preferably T323, V550 and T564, or
(iv) 225, 323 and 487, preferably N225, T323 and Q487, or
(v) 225, 487, 550 and 556, preferably N225, Q487, V550 and S556, or
(vi) 225, 487, 550 and 564, preferably N225, Q487, V550 and T564, or
(vii) 225, 550, 556 and 564, preferably N225, V550, S556 and T564, or
(viii) 225, 550, 564 and 649, preferably N225, V550, T564, A649, or
(ix) 323, 550, 556 and 564, preferably T323, V550, S556, T564, or
(x) 323, 487, 550 and 649, preferably T323, Q487, V550 and A649, or
(xii) 225, 487, 550, 556 and 564, preferably N225, Q487, V550, S556 and T564, or
(xiii) 225, 550, 556, 564 and 649, preferably N225, V550, S556, T564 and A649, or (xiv) 225, 323, 487, 550 and 564, preferably N225, T323, Q487, V550, T564, or
(xv) 225, 323, 487, 550 and 649, preferably N225, T323, Q487, V550 and A649, or
(xvi) 225, 323, 487, 550 and 556, preferably N225, T323, Q487, V550 and S556, or
(xvii) 225, 323, 550, 556, 564, preferably N225, T323, V550, S556, T564, or
(xviii) 323, 349, 487, 550 and 649, preferably T323, F349, Q487, V550 and A649, or
(ixx) 323, 487, 550, 556 and 564, preferably T323, Q487, V550, S556 and T564, or
(xx) 487, 550, 556, 564 and 649, preferably Q487, V550, S556, T564 and A649, or
(xxi) 225, 323, 349, 550, 556 and 649, preferably N225, T323, F349, V550, S556 and A649, or
(xxii) 225, 323, 487, 550, 556, 649, preferably N225, T323, Q487, V550, S556 and A649, or
(xxiii) 225, 349, 487, 550, 556 and 564, preferably N225, F349, Q487, V550, S556 and T564, and/or
(xxiv) 225, 349, 487, 550, 564 and 649, preferably N225, F349, Q487, V550, T564, A649, or
(xxv) 225, 487, 550, 556, 564 and 649, preferably N225, Q487, V550, S556, T564 and A649, or
(xxvi) 323, 487, 550, 556, 564 and 649, preferably T323, Q487, V550, S556, T564 and A649, or
(xxvii) 225, 323, 487, 550, 556, 564 and 649, preferably N225, T323, Q487, V550, S556, T564 and A649.

In a 76$^{th}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$, 18$^{th}$, 19$^{th}$, 20$^{th}$, 21$^{st}$, 22$^{nd}$, 23$^{rd}$, 24$^{th}$, 25$^{th}$, 26$^{th}$, 27$^{th}$, 28$^{th}$, 29$^{th}$, 30$^{th}$, 31$^{st}$, 32$^{nd}$, 33$^{rd}$, 34$^{th}$, 35$^{th}$, 36$^{th}$, 37$^{th}$, 38$^{th}$, 39$^{th}$, 40$^{th}$, 41$^{st}$, 42$^{nd}$, 43$^{rd}$, 44$^{th}$, 45$^{th}$, 46$^{th}$, 47$^{th}$, 48$^{th}$, 49$^{th}$, 50$^{th}$, 51$^{st}$, 52$^{nd}$, 53$^{rd}$, 54$^{th}$, 55$^{th}$, 56$^{th}$, 57$^{th}$, 58$^{th}$, 59$^{th}$, 60$^{th}$, 61$^{st}$, 62$^{nd}$, 63$^{rd}$, 64$^{th}$, 65$^{th}$, 66$^{th}$, 67$^{th}$, 68$^{th}$, 69$^{th}$, 70$^{th}$, 71$^{st}$, 72$^{nd}$, 73$^{rd}$, 74$^{th}$ and 75$^{th}$ embodiment or of any other of the previous embodiments of the first aspect, the substitution at any of the amino acid positions is selected from the group of amino acids consisting of A, R, N, D, C, Q, E, G, H, I, L, K, M, F, P, S, T, W, Y, and V, preferably the substitution at any of the amino acid positions is individually and independently selected from the group of amino acids consisting of A, R, N, D, C, Q, E, G, H, I, L, K, M, F, P, S, T, W, Y, and V.

In a 77$^{th}$ embodiment of the first aspect which is also an embodiment of the 76$^{th}$ embodiment of the first aspect, the substitution is at any of amino acid position of SEQ ID NO: 1 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705.

In a 78$^{th}$ embodiment of the first aspect which is also an embodiment of the 77$^{th}$ embodiment of the first aspect, the substitution is at any of amino acid position of SEQ ID NO: 1 L712, P383, V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705.

In a 79$^{th}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$, 18$^{th}$19$^{th}$, 20$^{th}$, 21$^{st}$, 22$^{nd}$, 23$^{rd}$, 24$^{th}$, 25$^{th}$, 26$^{th}$, 27$^{th}$, 28$^{th}$, 29$^{th}$, 30$^{th}$, 31$^{st}$, 32$^{nd}$, 33$^{rd}$, 34$^{th}$, 35$^{th}$, 36$^{th}$, 37$^{th}$, 38$^{th}$, 39$^{th}$, 40$^{th}$, 41$^{st}$, 42$^{nd}$, 43$^{rd}$, 44$^{th}$, 45$^{th}$, 46$^{th}$, 47$^{th}$, 48$^{th}$, 49$^{th}$, 50$^{th}$, 51$^{st}$, 52$^{nd}$, 53$^{rd}$, 54$^{th}$, 55$^{th}$, 56$^{th}$, 57$^{th}$, 58$^{th}$, 59$^{th}$, 60$^{th}$, 61$^{st}$, 62$^{nd}$, 63$^{rd}$, 64$^{th}$, 65$^{th}$, 66$^{th}$, 67$^{th}$, 68$^{th}$, 69$^{th}$, 70$^{th}$, 71$^{st}$, 72$^{nd}$, 73$^{rd}$, 74$^{th}$, 75$^{th}$, 76$^{th}$, 77$^{th}$ and 78$^{th}$ embodiment or of any other of the previous embodiments of the first aspect, preferably of the 76$^{th}$, 77$^{th}$ and 78$^{th}$ embodiment of the first aspect, the amino acid sequence of the trehalose phosphorylase comprises one or more substitutions, wherein the substitution is selected from the group consisting of an amino acid substitution at position V10 of SEQ ID NO: 1 with the substitution being V10R, V10H or V10K, preferably V10R;

an amino acid substitution at position L114 of SEQ ID NO: 1 with the substitution being L114A, L114G, L114I, L114M, L114P or L114V, preferably L114I;

an amino acid substitution at position I118 of SEQ ID NO: 1 with the substitution being I118A, I118G, I118L, I118M, I118P or I118V, preferably I118V;

an amino acid substitution at position S192 of SEQ ID NO: 1 with the substitution being S192A, S192G, S192I, S192L, S192M, S192P or S192V, preferably S192V;

an amino acid substitution at position S197 of SEQ ID NO: 1 with the substitution being S197A, S197G, S197I, S197L, S197M, S197P or S197V, preferably S197G;

an amino acid substitution at position Y220 of SEQ ID NO: 1 with the substitution being Y220F or Y220W, preferably Y220F;

an amino acid substitution at position N225 of SEQ ID NO: 1 with the substitution being N225A, N225G, N225I, N225L, N225M, N225P or N225V, preferably N225I, N225L, N225M or N225V, and more preferably N225V;

an amino acid substitution at position A304 of SEQ ID NO: 1 with the substitution being A304G, A304I, A304L, A304M, A304P or A304V, preferably A304I or A304L, and more preferably A304I;

an amino acid substitution at position D306 of SEQ ID NO: 1 with the substitution being D306R, D306H or D306K, preferably D306H;

an amino acid substitution at position P318 of SEQ ID NO: 1 with the substitution being P318R, P318H or P318K, preferably P318H;

an amino acid substitution at position T323 of SEQ ID NO: 1 with the substitution being T323A, T323G, T323I, T323L, T323M, T323P, or T323V, preferably T323I or T323V, and more preferably T323I;

an amino acid substitution at position L339 of SEQ ID NO: 1 with the substitution being L339A, L339G, L339I, L339L, L339M, L339P or L339V, preferably L339I;

an amino acid substitution at position F349 of SEQ ID NO: 1 with the substitution being F349W or F349Y, preferably F349Y;

an amino acid substitution at position G357 of SEQ ID NO: 1 with the substitution being G357A, G357I, G357L, G357M, G357P or G357V, preferably G357A;

an amino acid substitution at position P383 of SEQ ID NO: 1 with the substitution being P383A, P383G, P383I, P383L, P383M, P383V, P383N, P383C, P383Q, P383S or P383T, preferably P383A, P383G, P383M, P383V, P383N, P383C, P383Q, P383S or P383T, more preferably P383G, P383V, P383C or P383S, or P383T, even more preferably P383V or P383T, and most preferably P383V;

an amino acid substitution at position A459 of SEQ ID NO: 1 with the substitution being A459N, A459C, A459Q or A459S, A459T, preferably A459S;

an amino acid substitution at position Q476 of SEQ ID NO: 1 with the substitution being Q476A, Q476G, Q476I, Q476L, Q476M, Q476P or Q476V, preferably Q476G;

an amino acid substitution at position E481 of SEQ ID NO: 1 with the substitution being E481A, E481G, E481I, E481L, E481M, E481P or E481V, preferably E481I;

an amino acid substitution at position A484 of SEQ ID NO: 1 with the substitution being A484N, A484C, A484Q, A484S or A484T, preferably A484S;

an amino acid substitution at position Q487 of SEQ ID NO: 1 with the substitution being Q487A, Q487G, Q487I, Q487L, Q487M, Q487P or Q487V, preferably Q487A, Q487G, Q487L, Q487M or Q487V, more preferably Q487A;

an amino acid substitution at position K488 of SEQ ID NO: 1 with the substitution being K488A, K488G, K488I, K488L, K488M, K488P or K488V, preferably K488A;

an amino acid substitution at position A506 of SEQ ID NO: 1 with the substitution being A506N, A506C, A506Q, A506S or A506T, preferably A506S;

an amino acid substitution at position A511 of SEQ ID NO: 1 with the substitution being A511N, A511C, A511Q, A511S or A511T, preferably A511S;

an amino acid substitution at position R526 of SEQ ID NO: 1 with the substitution being R526D or R526E preferably R526E;

an amino acid substitution at position E530 of SEQ ID NO: 1 with the substitution being E530A, E530G, E530I, E530L, E530M, E530P, E530V, preferably E530V;

an amino acid substitution at position G532 of SEQ ID NO: 1 with the substitution being G532R, G532H or G532K, preferably G532R;

an amino acid substitution at position D533 of SEQ ID NO: 1 with the substitution being D533A, D533G, D533I, D533L, D533M, D533P or D533V, preferably D533G;

an amino acid substitution at position D537 of SEQ ID NO: 1 with the substitution being D537A, D537G, D537I, D537L, D537M, D537P or D537V, preferably D537M;

an amino acid substitution at position V550 of SEQ ID NO: 1 with the substitution being V550A, V550G, V550I, V550L, V550M or V550P, preferably V550I or V550P, and more preferably V550I;

an amino acid substitution at position S556 of SEQ ID NO: 1 with the substitution being S556N, S556C, S556Q or S556T, preferably S556T;

an amino acid substitution at position T564 of SEQ ID NO: 1 with the substitution being T564D or T564E, preferably T564E;

an amino acid substitution at position D590 of SEQ ID NO: 1 with the substitution being D590N, D590C, D590Q, D590S, D590T, D590A, D590G, D590I, D590L, D590M, D590P or D590V, preferably D590N, D590G or D590A, and more preferably D590N;

an amino acid substitution at position A649 of SEQ ID NO: 1 with the substitution being A649D or A649E, preferably A649E;

an amino acid substitution at position R667 of SEQ ID NO: 1 with the substitution being R667D, R667E, R667R, R667H or R667K, preferably R667E or R667K, more preferably R667E;

an amino acid substitution at position A703 of SEQ ID NO: 1 with the substitution being A703D or A703E, preferably A703E;

an amino acid substitution at position K705 of SEQ ID NO: 1 with the substitution being K705N, K705C, K705Q, K705S or K705T, preferably K705N; and an amino acid substitution at position L712 of SEQ ID NO: 1 with the substitution being L712A, L712G, L712I, L712M, L712P or L712V, preferably L712M.

In another preferred embodiment of the first aspect, which is also an embodiment of any of the embodiments of the first aspect of the invention, the trehalose phosphorylase comprises one or more substitutions, wherein the substitution is selected from the group consisting of amino acid positions L712M, P383G, P383V, P383C, P383S, P383T, V10R, L114I, 118V, S192V, S197G, Y220F, N225I, N225L, N225M, N225V, A304L, A304I, D306H, P318H, T323I, T323V, L339I, F349Y, G357A, A459S, Q476G, E481I, A484S, 487A, Q487G, Q487L, Q487M, Q487V, K488A, A506S, A511S, R526E, E530V, G532R, D533G, D537M, V550I, V550P, S556T, T564E, D590N, D590G, D590A, A649E, R667E, R667K, A703E, and K705N of SEQ ID NO: 1, preferably from the group consisting of amino acid positions P383G, P383V, P383C, P383S, P383T, V10R, L114I, S192V, S197G, N225I, N225L, N225M, N225V, A304L, A304I, D306H, P318H, T323I, T323V, L339I, F349Y, G357A, A459S, Q476G, E481I, A484SQ487G, Q487L, Q487M, Q487V, K488A, A506S, A511S, R526E, E530V, G532R, D533G, D537M, V550I, V550P, S556T, T564E, D590G, D590A, A649E, R667E, R667K, A703E, and K705N of SEQ ID NO: 1.

In an 80$^{th}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$, 18$^{th}$, 19$^{th}$, 20$^{th}$, 21$^{st}$, 22$^{nd}$, 23$^{rd}$, 24$^{th}$, 25$^{th}$, 26$^{th}$, 27$^{th}$, 28$^{th}$, 29$^{th}$, 30$^{th}$, 31$^{st}$, 32$^{nd}$, 33$^{rd}$, 34$^{th}$, 35$^{th}$, 36$^{th}$, 37$^{th}$, 38$^{th}$, 39$^{th}$, 40$^{th}$, 41$^{st}$, 42$^{nd}$, 43$^{rd}$, 44$^{th}$, 45$^{th}$, 46$^{th}$, 47$^{th}$, 48$^{th}$, 49$^{th}$, 50$^{th}$, 51$^{st}$, 52$^{nd}$, 53$^{rd}$, 54$^{th}$, 55$^{th}$, 56$^{th}$, 57$^{th}$, 58$^{th}$, 59$^{th}$, 60$^{th}$, 61$^{st}$, 62$^{nd}$, 63$^{rd}$, 64$^{th}$, 65$^{th}$, 66$^{th}$, 67$^{th}$, 68$^{th}$, 69$^{th}$, 70$^{th}$, 71$^{st}$, 72$^{nd}$, 73$^{rd}$, 74$^{th}$, 75$^{th}$, 76$^{th}$, 77$^{th}$, 78$^{th}$ and 79$^{th}$ embodiment or of any other of the previous embodiments of the first aspect, the identity of the amino acid sequence of the trehalose phosphorylase with the amino acid sequence of SEQ ID NO:

1 is at least 81%, or at least 82%, or at least 83%, or at least 84%, or at least 85%, still more preferably at least 86%, or at least 87%, or at least 88%, or at least 89%, or at least 90%, yet more preferably at least 91%, or at least 92%, or at least 93%, or at least 94%, or at least 95%, and most preferably at least 96%, or at least 97%, or at least 98%, or at least 99%, at least 99.1%, or at least 99.2%, or at least 99.3%, or at least 99.4%, or at least 99.5%, or at least 99.6%, or at least 99.7%, or at least 99.8%, and in particular at least 99.9%, or 100%.

In an 81$^{st}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$, 18$^{th}$, 19$^{th}$, 20$^{th}$, 21$^{st}$, 22$^{nd}$, 23$^{rd}$, 24$^{th}$, 25$^{th}$, 26$^{th}$, 27$^{th}$, 28$^{th}$, 29$^{th}$, 30$^{th}$, 31$^{st}$, 32$^{nd}$, 33$^{rd}$, 34$^{th}$, 35$^{th}$, 36$^{th}$, 37$^{th}$, 38$^{th}$, 39$^{th}$, 40$^{th}$, 41$^{st}$, 42$^{nd}$, 43$^{rd}$, 44$^{th}$, 45$^{th}$, 46$^{th}$, 47$^{th}$, 48$^{th}$, 49$^{th}$, 50$^{th}$, 51$^{st}$, 52$^{nd}$, 53$^{rd}$, 54$^{th}$, 55$^{th}$, 56$^{th}$, 57$^{th}$, 58$^{th}$, 59$^{th}$, 60$^{th}$, 61$^{st}$, 62$^{nd}$, 63$^{rd}$, 64$^{th}$, 65$^{th}$, 66$^{th}$, 67$^{th}$, 68$^{th}$, 69$^{th}$, 70$^{th}$, 71$^{st}$, 72$^{nd}$, 73$^{rd}$, 74$^{th}$, 75$^{th}$, 76$^{th}$, 77$^{th}$, 78$^{th}$, 79$^{th}$ and 80$^{th}$ embodiment or of any other of the previous embodiments of the first aspect, the amino acid sequence of the trehalose phosphorylase is at least 85% identical to the amino acid sequence of SEQ ID NO: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, or 190.

In an 82$^{nd}$ embodiment of the first aspect which is also an embodiment of the 81$^{st}$ embodiment of the first aspect, the amino acid sequence of the trehalose phosphorylase is at least 85% identical to the amino acid sequence of SEQ ID NO: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 87, 88, 89, 91, 93, 94, 95, 97, 98, 101, 103, 104, 105, 107, 109, 110, 111, 113, 114, 115, 117, 119, 121, 123, 125, 128, 130, 131, 132, 133, 134, 135, 136, 137, 138, 139, 140, 141, 146, 147, 149, 150, 151, 152, 154, 155, 156, 157, 158, 159, or 190.

In a preferred embodiment of the first aspect, which is also an embodiment of any other of the previous embodiments of the first aspect, the amino acid sequence of the trehalose phosphorylase is at least 85% identical to the amino acid sequence of SEQ ID NO: 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 155, 156, 157, or 190.

In an 83$^{rd}$ embodiment of the first aspect which is also an embodiment of the 82$^{nd}$ embodiment of the first aspect, the amino acid sequence of the trehalose phosphorylase is at least 85% identical to the amino acid sequence of SEQ ID NO: 3, 7, 9, 10, 12, 13, 15, 20, 29, 44, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 98, 104, 110, 113, 115, 121, 125, 132, 133, 134, 135, 136, 137, 138, 139, 140, 141, 147, 152, 154, 155, 156, 157, 158, 159, or 190.

In a preferred embodiment of the first aspect, which is also an embodiment of any other of the previous embodiments of the first aspect, the amino acid sequence of the trehalose phosphorylase is at least 85% identical to the amino acid sequence of SEQ ID NO: 44, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 190.

In an 84$^{th}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$, 18$^{th}$, 19$^{th}$, 20$^{th}$, 21$^{st}$, 22$^{nd}$, 23$^{rd}$, 24$^{th}$, 25$^{th}$, 26$^{th}$, 27$^{th}$, 28$^{th}$, 29$^{th}$, 30$^{th}$, 31$^{st}$, 32$^{nd}$, 33$^{rd}$, 34$^{th}$, 35$^{th}$, 36$^{th}$, 37$^{th}$, 38$^{th}$, 39$^{th}$, 40$^{th}$, 41$^{st}$, 42$^{nd}$, 43$^{rd}$, 44$^{th}$, 45$^{th}$, 46$^{th}$, 47$^{th}$, 48$^{th}$, 49$^{th}$, 50$^{th}$, 51$^{st}$, 52$^{nd}$, 53$^{rd}$, 54$^{th}$, 55$^{th}$, 56$^{th}$, 57$^{th}$, 58$^{th}$, 59th, 60th, 61st, 62nd, 63rd, 64th, 65th, 66th, 67th, 68th, 69th, 70th, 71st, 72nd, 73rd, 74th, 75th, 76th, 77th, 78th, 79th, 80th, 81st, 82nd and 83rd embodiment or of any other of the previous embodiments of the first aspect, the amino acid sequence of the trehalose phosphorylase is least 85% identical to two or more of the amino acid sequences of SEQ ID NO: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78 79, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, or 190.

In an 85th embodiment of the first aspect which is also an embodiment of the 84th embodiment of the first aspect, the amino acid sequence of the trehalose phosphorylase is at least 85% identical to two or more of the amino acid sequences of SEQ ID NO: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 87, 88, 89, 91, 93, 94, 95, 97, 98, 101, 103, 104, 105, 107, 109, 110, 111, 113, 114, 115, 117, 119, 121, 123, 125, 128, 130, 131, 132, 133, 134, 135, 136, 137, 138, 139, 140, 141, 146, 147, 149, 150, 151, 152, 154, 155, 156, 157, 158, 159, or 190.

In another preferred embodiment of the first aspect, which is also an embodiment of any other of the previous embodiments of the first aspect, the amino acid sequence of the trehalose phosphorylase is at least 85% identical to two or more of the amino acid sequences of SEQ ID NO: 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 155, 156, 157, or 190

In an 86th embodiment of the first aspect which is also an embodiment of the 85th embodiment of the first aspect, the amino acid sequence of the trehalose phosphorylase is at least 85% identical to two or more of the amino acid sequences of SEQ ID NO: 3, 7, 9, 10, 12, 13, 15, 20, 29, 44, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 98, 104, 110, 113, 115, 121, 125, 132, 133, 134, 135, 136, 137, 138, 139, 140, 141, 147, 152, 154, 155, 156, 157, 158, 159, or 190.

In another preferred embodiment of the first aspect, which is also an embodiment of any other of the previous embodiments of the first aspect, the amino acid sequence of the trehalose phosphorylase is at least 85% identical to two or more of the amino acid sequences of SEQ ID NO: 44, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 190.

In an 87th embodiment of the first aspect which is also an embodiment of the 80th, 81st, 82nd, 83rd, 84th, 85th and 86th embodiment or of any other of the previous embodiments of the first aspect, the identity of the amino acid sequence is at least 86%, or at least 87%, or at least 88%, or at least 89%, or at least 90%, more preferably at least 91%, or at least 92%, or at least 93%, or at least 94%, or at least 95%, and most preferably at least 96%, or at least 97%, or at least 98%, or at least 99%, at least 99.1%, or at least 99.2%, or at least 99.3%, or at least 99.4%, or at least 99.5%, or at least 99.6%, or at least 99.7%, or at least 99.8%, and in particular at least 99.9%, or 100%.

In an 88th embodiment of the first aspect which is also an embodiment of the first, second, third, fourth, fifth, sixth, seventh, eighth, ninth, tenth, eleventh, twelfth, 13th, 14th, 15th, 16th, 17th, 18th, 19th, 20th, 21st, 22nd, 23rd, 24th, 25th, 26th, 27th, 28th, 29th, 30th, 31st, 32nd, 33rd, 34th, 35th, 36th, 37th, 38th, 39th, 40th, 41st, 42nd, 43rd, 44th, 45th, 46th, 47th, 48th, 49th, 50th, 51st, 52nd, 53rd, 54th, 55th, 56th, 57th, 58th, 59th, 60th, 61st, 62nd, 63rd, 64th, 65th, 66th, 67th, 68th, 69th, 70th, 71st, 72nd, 73rd, 74th, 75th, 76th, 77th, 78th, 79th, 80th, 81st, 82nd, 83rd, 84th, 85th, 86th and 87th embodiment or of any other of the previous embodiments of the first aspect, preferably of the first, second, third, fourth, fifth, sixth, seventh, eighth, ninth, tenth, eleventh, twelfth, 13th, 14th, 15th, 16th, 17th, 18th, 19th, 20th, 21st, 22nd, 23rd, 24th, 25th, 26th, 27th, 28th, 29th, 30th, 31st, 32nd, 33rd, 34th, 35th, 36th, 37th, 38th, 39th, 40th, 41st, 42nd, 43rd, 44th, 45th, 46th, 47th, 48th, 49th, 50th, 51st, 52nd, 53rd, 54th, 55th, 56th, 57th, 58th, 59th, 60th, 61st, 62nd, 63rd, 64th, 65th, 66th, 67th, 68th, 69th, 70th, 71st, 72nd, 73rd, 74th, 75th, 76th, 77th, 78th and 79th embodiment or of any other of the previous embodiments of the first aspect, the homology of the amino acid sequence of the trehalose phosphorylase with the amino acid sequence of SEQ ID NO: 1 is at least 81%, or at least 82%, or at least 83%, or at least 84%, or at least 85%, still more preferably at least 86%, or at least 87%, or at least 88%, or at least 89%, or at least 90%, yet more preferably at least 91%, or at least 92%, or at least 93%, or at least 94%, or at least 95%, and most preferably at least 96%, or at least 97%, or at least 98%, or at least 99%, at least 99.1%, or at least 99.2%, or at least 99.3%, or at least 99.4%, or at least 99.5%, or at least 99.6%, or at least 99.7%, or at least 99.8%, and in particular at least 99.9%, or 100%.

In an 89th embodiment of the first aspect which is also an embodiment of the first, second, third, fourth, fifth, sixth, seventh, eighth, ninth, tenth, eleventh, twelfth, 13th, 14th, 15th, 16th, 17th, 18th, 19th, 20th, 21st, 22nd, 23rd, 24th, 25th, 26th, 27th, 28th, 29th, 30th, 31st, 32nd, 33rd, 34th, 35th, 36th, 37th, 38th, 39th, 40th, 41st, 42nd, 43rd, 44th, 45th, 46th, 47th, 48th, 49th, 50th, 51st, 52nd, 53rd, 54th, 55th, 56th, 57th, 58th, 59th, 60th, 61st, 62nd, 63rd, 64th, 65th, 66th, 67th, 68th, 69th, 70th, 71st, 72nd, 73rd, 74th, 75th, 76th, 77th, 78th, 79th, 80th, 81st, 82nd, 83rd, 84th, 85th, 86th, 87th and 88th embodiment or of any other of the previous embodiments of the first aspect, the amino acid sequence of the trehalose phosphorylase is at least 85% homologous to the amino acid sequence of SEQ ID NO: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, or 159.

In a 90th embodiment of the first aspect which is also an embodiment of the 89th embodiment of the first aspect, the amino acid sequence of the trehalose phosphorylase is at least 85% homologous to the amino acid sequence of SEQ ID NO: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 87, 88, 89, 91, 93, 94, 95, 97, 98, 101, 103, 104, 105, 107, 109, 110, 111, 113, 114, 115, 117, 119, 121, 123, 125, 128, 130, 131, 132, 133, 134, 135, 136, 137, 138, 139, 140, 141, 146, 147, 149, 150, 151, 152, 154, 155, 156, 157, 158, 159, or 190.

In another preferred embodiment of the first aspect, which is also an embodiment of any other of the previous embodiments of the first aspect, the amino acid sequence of the trehalose phosphorylase is at least 85% homologous to the amino acid sequence of SEQ ID NO: ID NO: 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 155, 156, 157, or 190.

In a 91$^{st}$ embodiment of the first aspect which is also an embodiment of the 90$^{th}$ embodiment of the first aspect, the amino acid sequence of the trehalose phosphorylase is at least 85% homologous to the amino acid sequence of SEQ ID NO: 3, 7, 9, 10, 12, 13, 15, 20, 29, 44, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 98, 104, 110, 113, 115, 121, 125, 132, 133, 134, 135, 136, 137, 138, 139, 140, 141, 147, 152, 154, 155, 156, 157, 158, 159, or 190.

In a preferred embodiment of the first aspect, which is also an embodiment of any other of the previous embodiments of the first aspect, the amino acid sequence of the trehalose phosphorylase is at least 85% homologous to the amino acid sequences of SEQ ID NO: 44, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 190.

In a 92$^{nd}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$, 18$^{th}$, 19$^{th}$, 20$^{th}$, 21$^{st}$, 22$^{nd}$, 23$^{rd}$, 24$^{th}$, 25$^{th}$, 26$^{th}$, 27$^{th}$, 28$^{th}$, 29$^{th}$, 30$^{th}$, 31$^{st}$, 32$^{nd}$, 33$^{rd}$, 34$^{th}$, 35$^{th}$, 36$^{th}$, 37$^{th}$, 38$^{th}$, 39$^{th}$, 40$^{th}$, 41$^{st}$, 42$^{nd}$, 43$^{rd}$, 44$^{th}$, 45$^{th}$, 46$^{th}$, 47$^{th}$, 48$^{th}$, 49$^{th}$, 50$^{th}$, 51$^{st}$, 52$^{nd}$, 53$^{rd}$, 54$^{th}$, 55$^{th}$, 56$^{th}$, 57$^{th}$, 58$^{th}$, 59$^{th}$, 60$^{th}$, 61$^{st}$, 62$^{nd}$, 63$^{rd}$, 64$^{th}$, 65$^{th}$, 66$^{th}$, 67$^{th}$, 68$^{th}$, 69$^{th}$, 70$^{th}$, 71$^{st}$, 72$^{nd}$, 73$^{rd}$, 74$^{th}$, 75$^{th}$, 76$^{th}$, 77$^{th}$, 78$^{th}$, 79$^{th}$, 80$^{th}$, 81$^{st}$, 82$^{nd}$, 83$^{rd}$, 84$^{th}$, 85$^{th}$, 86$^{th}$, 87$^{th}$, 88$^{th}$, 89$^{th}$, 90$^{th}$ and 91$^{st}$ embodiment or of any other of the previous embodiments of the first aspect, the amino acid sequence of the trehalose phosphorylase is least 85% homologous to two or more of the amino acid sequences of SEQ ID NO: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78 79, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, or 190.

In a 93$^{rd}$ embodiment of the first aspect which is also an embodiment of the 92$^{nd}$ embodiment of the first aspect, the amino acid sequence of the trehalose phosphorylase is at least 85% homologous to two or more of the amino acid sequences of SEQ ID NO: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 87, 88, 89, 91, 93, 94, 95, 97, 98, 101, 103, 104, 105, 107, 109, 110, 111, 113, 114, 115, 117, 119, 121, 123, 125, 128, 130, 131, 132, 133, 134, 135, 136, 137, 138, 139, 140, 141, 146, 147, 149, 150, 151, 152, 154, 155, 156, 157, 158, 159, or 190.

In a preferred embodiment of the first aspect, which is also an embodiment of any other of the previous embodiments of the first aspect, the amino acid sequence of the trehalose phosphorylase is at least 85% homologous to two or more of the amino acid sequences of SEQ ID NO: 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 155, 156, 157, or 190.

In a 94$^{th}$ embodiment of the first aspect which is also an embodiment of the 93$^{rd}$ embodiment of the first aspect, the amino acid sequence of the trehalose phosphorylase is at least 85% identical to two or more of the amino acid sequences of SEQ ID NO: 3, 7, 9, 10, 12, 13, 15, 20, 29, 44, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 98, 104, 110, 113, 115, 121, 125, 132, 133, 134, 135, 136, 137, 138, 139, 140, 141, 147, 152, 154, 155, 156, 157, 158, 159, or 190.

In a preferred embodiment of the first aspect, which is also an embodiment of any other of the previous embodiments of the first aspect, the amino acid sequence of the trehalose phosphorylase is at least 85% identical to two or more of the amino acid sequences of SEQ ID NO: 44, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, or 190.

In a 95$^{th}$ embodiment of the first aspect which is also an embodiment of the 88$^{th}$, 89$^{th}$, 90$^{th}$, 91$^{th}$, 92$^{nd}$, 93$^{rd}$ and 94$^{th}$ embodiment or of any other of the previous embodiments of the first aspect, the homology of the amino acid sequence is at least 86%, or at least 87%, or at least 88%, or at least 89%, or at least 90%, more preferably at least 91%, or at least 92%, or at least 93%, or at least 94%, or at least 95%, and most preferably at least 96%, or at least 97%, or at least 98%, or at least 99%, at least 99.1%, or at least 99.2%, or at least 99.3%, or at least 99.4%, or at least 99.5%, or at least 99.6%, or at least 99.7%, or at least 99.8%, and in particular at least 99.9%, or 100%.

In a 96$^{th}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$, 18$^{th}$, 19$^{th}$, 20$^{th}$, 21$^{st}$, 22$^{nd}$, 23$^{rd}$, 24$^{th}$, 25$^{th}$, 26$^{th}$, 27$^{th}$, 28$^{th}$, 29$^{th}$, 30$^{th}$, 31$^{st}$, 32$^{nd}$, 33$^{rd}$, 34$^{th}$, 35$^{th}$, 36$^{th}$, 37$^{th}$, 38$^{th}$, 39$^{th}$, 40$^{th}$, 41$^{st}$, 42$^{nd}$, 43$^{rd}$, 44$^{th}$, 45$^{th}$, 46$^{th}$, 47$^{th}$, 48$^{th}$, 49$^{th}$, 50$^{th}$, 51$^{st}$, 52$^{nd}$, 53$^{rd}$, 54$^{th}$, 55$^{th}$, 56$^{th}$, 57$^{th}$, 58$^{th}$, 59$^{th}$, 60$^{th}$, 61$^{st}$, 62$^{nd}$, 63$^{rd}$, 64$^{th}$, 65$^{th}$, 66$^{th}$, 67$^{th}$, 68$^{th}$, 69$^{th}$, 70$^{th}$, 71, 72$^{nd}$, 73$^{rd}$, 74$^{th}$, 75$^{th}$, 76$^{th}$, 77$^{th}$, 78$^{th}$, 79$^{th}$, 80$^{th}$, 81$^{st}$, 82$^{nd}$, 83$^{rd}$, 84$^{th}$, 85$^{th}$, 86$^{th}$, 87$^{th}$, 88$^{th}$, 89$^{th}$, 90$^{th}$, 91$^{st}$, 92$^{nd}$, 93$^{rd}$, 94$^{th}$ and 95$^{th}$ embodiment or of any other of the previous embodiments of the first aspect, the problem underlying the present invention is solved by a polypeptide, preferably a polypeptide, wherein the polypeptide comprises an amino acid sequence of SEQ ID NO: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, 145, 146, 147, 148, 149, 150, 151, 152, 153, 154, 155, 156, 157, 158, 159, or 190. In a preferred embodiment, the polypeptide is a trehalose phosphorylase. Whenever in this disclosure it is referred to the polypeptide and trehalose phosphorylase of the first aspect and any embodiment thereof, such first aspect includes any subaspects thereof, including any embodiment thereof.

In a 97$^{th}$ embodiment of the first aspect which is also an embodiment of the 96$^{th}$ embodiment of the first aspect, the polypeptide comprises or consists of an amino acid sequence of SEQ ID NO: 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 87, 88, 89, 91, 93, 94, 95, 97, 98, 101, 103, 104, 105, 107, 109, 110, 111, 113, 114, 115, 117, 119, 121, 123, 125, 128, 130, 131, 132, 133, 134, 135, 136, 137, 138, 139, 140, 141, 146, 147, 149, 150, 151, 152, 154, 155, 156, 157, 158, 159, or 190.

In a 98$^{th}$ embodiment of the first aspect which is also an embodiment of the 97$^{th}$ embodiment of the first aspect, the polypeptide, preferably the trehalose phosphorylase, comprises or consists of an amino acid sequence of SEQ ID NO: 3, 7, 9, 10, 12, 13, 15, 20, 29, 44, 45, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 98, 104, 110, 113, 115, 121, 125, 132, 133, 134, 135, 136, 137, 138, 139, 140, 141, 147, 152, 154, 155, 156, 157, 158, 159, or 190.

In a 99$^{th}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$, 18$^{th}$, 19$^{th}$, 20$^{th}$, 21$^{st}$, 22$^{nd}$, 23$^{rd}$, 24$^{th}$, 25$^{th}$, 26$^{th}$, 27$^{th}$, 28$^{th}$, 29$^{th}$, 30$^{th}$, 31$^{st}$, 32$^{nd}$, 33$^{rd}$, 34$^{th}$, 35$^{th}$, 36$^{th}$, 37$^{th}$, 38$^{th}$, 39$^{th}$, 40$^{th}$, 41$^{st}$, 42$^{nd}$, 43$^{rd}$, 44$^{th}$, 45$^{th}$, 46$^{th}$, 47$^{th}$, 48$^{th}$, 49$^{th}$, 50$^{th}$, 51$^{st}$, 52$^{nd}$, 53$^{rd}$, 54$^{th}$, 55$^{th}$, 56$^{th}$, 57$^{th}$, 58$^{th}$, 59$^{th}$, 60$^{th}$, 61$^{st}$, 62$^{nd}$, 63$^{rd}$, 64$^{th}$, 65$^{th}$, 66$^{th}$, 67$^{th}$, 68$^{th}$, 69$^{th}$, 70$^{th}$, 71$^{st}$, 72$^{nd}$, 73$^{rd}$, 74$^{th}$, 75$^{th}$, 76$^{th}$, 77$^{th}$, 78$^{th}$, 79$^{th}$, 80$^{th}$, 81$^{st}$, 82$^{nd}$, 83$^{rd}$, 84$^{th}$, 85$^{th}$, 86$^{th}$, 87$^{th}$, 88$^{th}$, 89$^{th}$, 90$^{th}$, 91$^{st}$, 92$^{nd}$, 93$^{rd}$, 94$^{th}$, 95$^{th}$, 96$^{th}$, 97$^{th}$ and 98$^{th}$ embodiment or of any other of the previous embodiments of the first aspect, the polypeptide, preferably the trehalose phosphorylase, is capable of catalyzing the reaction of a glycosyl monosaccharide and alpha-D-glucose-1 phosphate.

In a 100$^{th}$ embodiment of the first aspect which is also an embodiment of the 99$^{th}$ embodiment of the first aspect, the polypeptide, preferably the trehalose phosphorylase is capable of catalyzing conversion of glucose and alpha-D-glucose-1 phosphate to trehalose and inorganic phosphate
and/or
conversion of trehalose and inorganic phosphate to glucose and alpha-D-glucose-1 phosphate.

In a 101$^{st}$ embodiment of the first aspect which is also an embodiment of the 99$^{th}$ and 100$^{th}$ embodiment of the first aspect, the conversion is a reversible conversion.

In a 102$^{nd}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$, 18$^{th}$, 19$^{th}$, 20$^{th}$, 21$^{st}$, 22$^{nd}$, 23$^{rd}$, 24$^{th}$, 25$^{th}$, 26$^{th}$, 27$^{th}$, 28$^{th}$, 29$^{th}$, 30$^{th}$, 31$^{st}$, 32$^{nd}$, 33$^{rd}$, 34$^{th}$, 35$^{th}$, 36$^{th}$, 37$^{th}$, 38$^{th}$, 39$^{th}$, 40$^{th}$, 41$^{st}$, 42$^{nd}$, 43$^{rd}$, 44$^{th}$, 45$^{th}$, 46$^{th}$, 47$^{th}$, 48$^{th}$, 49$^{th}$, 50$^{th}$, 51$^{st}$, 52$^{nd}$, 53$^{rd}$, 54$^{th}$, 55$^{th}$, 56$^{th}$, 57$^{th}$, 58$^{th}$, 59$^{th}$, 60$^{th}$, 61$^{st}$, 62$^{nd}$, 63$^{rd}$, 64$^{th}$, 65$^{th}$, 66$^{th}$, 67$^{th}$, 68$^{th}$, 69$^{th}$, 70$^{th}$, 71$^{st}$, 72$^{nd}$, 73$^{rd}$, 74$^{th}$, 75$^{th}$, 76$^{th}$, 77$^{th}$, 78$^{th}$, 79$^{th}$, 80$^{th}$, 81$^{st}$, 82$^{nd}$, 83$^{rd}$, 84$^{th}$, 85$^{th}$, 86$^{th}$, 87$^{th}$, 88$^{th}$, 89$^{th}$, 90$^{th}$, 91$^{st}$, 92$^{nd}$, 93$^{rd}$, 94$^{th}$, 95$^{th}$, 96$^{th}$, 97$^{th}$, 98$^{th}$, 99$^{th}$, 100$^{th}$ and 101$^{st}$ embodiment or of any other of the previous embodiments of the first aspect, the polypeptide, preferably the trehalose phosphorylase is a trehalose phosphorylase according to EC number EC 2.4.1.231.

In a 103$^{rd}$ embodiment of the first aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$, 18$^{th}$, 19$^{th}$, 20$^{th}$, 21$^{st}$, 22$^{nd}$, 23$^{rd}$, 24$^{th}$, 25$^{th}$, 26$^{th}$, 27$^{th}$, 28$^{th}$, 29$^{th}$, 30$^{th}$, 31, 32$^{nd}$, 33$^{rd}$, 34$^{th}$, 35$^{th}$, 36$^{th}$, 37$^{th}$, 38$^{th}$, 39$^{th}$, 40$^{th}$, 41$^{st}$, 42$^{nd}$, 43$^{rd}$, 44$^{th}$, 45$^{th}$, 46$^{th}$, 47$^{th}$, 48$^{th}$, 49$^{th}$, 50$^{th}$, 51$^{st}$, 52$^{nd}$, 53$^{rd}$, 54$^{th}$, 55$^{th}$, 56$^{th}$, 57$^{th}$, 58$^{th}$, 59$^{th}$, 60$^{th}$, 61$^{st}$, 62$^{nd}$, 63$^{rd}$, 64$^{th}$, 65$^{th}$, 66$^{th}$, 67$^{th}$, 68$^{th}$, 69$^{th}$, 70$^{th}$, 71$^{st}$, 72$^{nd}$, 73$^{rd}$, 74$^{th}$, 75$^{th}$, 76$^{th}$, 77$^{th}$, 78$^{th}$, 79$^{th}$, 80$^{th}$, 81$^{st}$, 82$^{nd}$, 83$^{rd}$, 84$^{th}$, 85$^{th}$, 86$^{th}$, 87$^{th}$, 88$^{th}$, 89$^{th}$, 90$^{th}$, 91$^{st}$, 92$^{nd}$, 93$^{rd}$, 94$^{th}$, 95$^{th}$, 96$^{th}$, 97$^{th}$, 98$^{th}$, 99$^{th}$, 100$^{th}$, 101$^{st}$ and 102$^{nd}$ embodiment or of any other of the previous embodiments of the first aspect, the polypeptide, preferably the trehalose phosphorylase, has at least one of characteristics (A), (B), (C), (D) and (E), or any combination thereof, wherein characteristic (A) is thermal stability after incubation at 52° C. for 15 minutes defined by a residual activity of i) from 30% to 90%, preferably from 39% to 90%, more preferably from 42% to 90%, more preferably from 54% to 90%, more preferably from 55% to 90%, and even more preferably from 63% to 90%, even more preferably from 64% to 90%, even more preferably from 68% to 90%, and most preferably from 64% to 86%, and/or ii) from 30% to 90%, preferably from 31% to 90%, preferably from 32% to 90%, preferably from 33% to 90%, preferably from 34% to 90%, preferably from 35% to 90%, preferably from 36% to 90%, preferably from 37% to 90%, preferably from 38% to 90%, preferably from 39% to 90%, more preferably from 40% to 90%, more preferably from 41% to 90%, more preferably from 42% to 90%, more preferably from 43% to 90%, more preferably from 44% to 90%, more preferably from 45% to 90%, more preferably from 46% to 90%, more preferably from 47% to 90%, more preferably from 48% to 90%, more preferably from 49% to 90%, even more preferably from 50% to 90%, even more preferably from 51% to 90%, even more preferably from 52% to 90%, even more preferably from 53% to 90%, even more preferably from 54% to 90%, even more preferably from 55% to 90%, even more preferably from 60% to 90%, even more preferably from 61% to 90%, even more preferably from 65% to 90%, even more preferably from 70% to 90%, even more preferably from 75% to 90%, and most preferably from 72% to 81%, and/or iii) from 55% to 100%, preferably from 60% to 100%, preferably from 70% to 100%, preferably from 75% to 100%, preferably from 76% to 100%, preferably from 77% to 100%, preferably from 78% to 100%, preferably from 79% to 100%, more preferably from 80% to 100%, more preferably from 81% to 100%, more preferably from 82% to 100%, more preferably from 83% to 100%, more preferably from 84% to 100%, more preferably from 85% to 100%, more preferably from 86% to 100%, more preferably from 87% to 100%, more preferably from 88% to 100%, more preferably from 89% to 100%, even more preferably from 90% to 100%, even more preferably from 91% to 100%, even more preferably from 92% to 100%, even more preferably from 93% to 100%, even more preferably from 94% to 100%, even more preferably from 95% to 100%, even more preferably from 96% to 100%, even more preferably from 97% to 100%, even more preferably from 98% to 100%, even more preferably from 99% to 100%, and most preferably 100%, and wherein characteristic (B) is thermal stability after incubation at 52° C. for 15 minutes which is characterized by
i) a Tm30-value of at least 52° C., and/or
ii) a Tm50-value of at least 52° C., and
wherein characteristic (C) is thermal stability characterized by
i) a Tm30-value between 52° C. and 90° C., preferably between 52° C. and 80° C., preferably between 52.5° C. and 80° C., preferably between 53° C. and 80° C., preferably between 53.5° C. and 80° C., more preferably between 54° C. and 80° C., preferably between 54.5° C. and 80° C., even more preferably between 55° C. and 80° C., preferably between 55.5° C. and 80° C., preferably between 56° C. and 80° C., preferably between 56.5° C. and 80° C., preferably between 57° C. and 80° C., preferably between 57.5° C. and 80° C., preferably between 58° C. and 80° C., preferably between 58.5° C. and 80° C., even more preferably between 52° C. and 70° C., even more preferably between 52.5° C. and 70° C., even more preferably between 53° C. and 70° C., even more preferably between 53.5° C. and 70° C., more even more preferably between 54° C. and 70° C., even more preferably between 54.5° C. and 70° C., even more even more preferably between 55° C. and 70° C., even more preferably between 55.5° C. and 70° C., even more preferably between 56° C. and 70° C., even more preferably between 56.5° C. and 70° C., even more preferably between 57° C. and 70° C., even more preferably between 57.5° C. and 70° C., even more preferably between 58° C. and 70° C., even more preferably between 58.5° C. and 70° C., even more preferably between 52° C. and 65° C., even more preferably between 52.5° C. and 65° C., even more preferably between 53° C. and 65° C., even more preferably between 53.5° C. and 65° C., more even more preferably between 54° C. and 65° C., even more preferably between 54.5° C. and 65° C., even more even more preferably between 55° C. and 65° C., even more preferably between 55.5° C. and 65° C., even more preferably between 56° C. and 65° C., even more preferably between 56.5° C. and 65° C., even more preferably between 57° C. and 65° C., even more preferably between 57.5° C. and 65° C., even more preferably between 58° C. and 65° C., even more preferably between 58.5° C. and 65° C., even more preferably between 52° C. and 60° C., even more preferably between 52.5° C. and 60° C., even more preferably between 53° C. and 60° C., even more preferably between 53.5° C. and 60° C., more even more preferably between 54° C. and 60° C., even more preferably between 54.5° C. and 60° C., even more even more preferably between 55° C. and 60° C., even more preferably between 55.5° C. and 60° C., even more preferably between 56° C. and 60° C., even more preferably between 56.5° C. and 60° C., even more preferably between 57° C. and 60° C., even more preferably between 57.5° C. and 60° C., even more preferably between 58° C. and 60° C., even more preferably between 58.5° C. and 60° C., and most preferably between 53.5° C. and 58.5° C. and/or
ii) a Tm50-value between 52° C. and 90° C., preferably between 52° C. and 80° C., preferably between 52.5° C. and 80° C., preferably between 53° C. and 80° C., preferably between 53.5° C. and 80° C., more preferably between 54° C. and 80° C., preferably between 54.5° C. and 80° C., even more preferably between 55° C. and 80° C., preferably between 55.5° C. and 80° C., preferably between 56° C. and 80° C., preferably between 56.5° C. and 80° C., preferably between 57° C. and 80° C., preferably between 57.5° C. and 80° C., even more preferably between 52° C. and 70° C., even more preferably between 52.5° C. and 70° C., even more preferably between 53° C. and 70° C., even more preferably between 53.5° C. and 70° C., more even more preferably between 54° C. and 70° C., even more preferably between 54.5° C. and 70° C., even more even more preferably between 55° C. and 70° C., even more preferably between 55.5° C. and 70° C., even more preferably between 56° C. and 70° C., even more preferably between 56.5° C. and 70° C., even more preferably between 57° C. and 70° C., even more preferably between 57.5° C. and 70° C., even more preferably between 52° C. and 65° C., even more preferably between 52.5° C. and 65° C., even more preferably between 53° C. and 65° C., even more preferably between 53.5° C. and 65° C., more even more preferably between 54° C. and 65° C., even more preferably between 54.5° C. and 65° C., even more even more preferably between 55° C. and 65° C., even more preferably between 55.5° C. and 65° C., even more preferably between 56° C. and 65° C., even more preferably between 56.5° C. and 65° C., even more preferably between 57° C. and 65° C., even more preferably between 57.5° C. and 65° C., even more preferably between 52° C. and 60° C., even more preferably between 52.5° C. and 60° C., even more preferably between 53° C. and 60° C., even more preferably between 53.5° C. and 60° C., more even more preferably between 54° C. and 60° C., even more preferably between 54.5° C. and 60° C., even more even more preferably between 55° C. and 60° C., even more preferably between 55.5° C. and 60° C., even more preferably between 56° C. and 60° C., even more preferably between 56.5° C. and 60° C., even more preferably between 57° C. and 60° C., even more preferably between 57.5° C. and 60° C., and most preferably between 52° C. and 57.5° C.
and
wherein characteristic (D) is thermal stability characterized by
i) a process stability, characterized by a half-life at 45° C. of from 3 hours to 9 days or more, preferably of from 24 hours to 9 days or more, preferably of from 39 hours to 9 days or more, preferably of from 2 days to 9 days or more, more preferably of from 4 days to 9 days or more, more preferably of from 5.5 days to 9 days or more, more preferably of from least 7 days to 9 days or more, even more preferably of at least 9 days or more, and most preferably of 9 days;
ii) a process stability, characterized by a half-life at 45° C. of from 24 hours to 9 days or more, more preferably of from 39 hours to 9 days or more, more preferably of from 2 days to 9 days or more, more preferably of from 4 days to 9 days or more, more preferably of from 5.5 days to 9 days or more, more preferably of from 7 days to 9 days or more, even more preferably of at least 9 days or more, and most preferably of 9 days; iii) a process stability, characterized by a half-life at 45° C. of 4 days to 9 days or more, preferably of from 5.5 days up to 9 days or more, more preferably of from 7 days up to 9 days or more, even more preferably of at least 9 days or more, and most preferably of 9 days; and wherein characteristic (E) is relative activity expressed as 100/500-ratio of
i) between 0.65 and 1.0, preferably of between 0.7 and 1.0, preferably of between 0.75 and 1.0, preferably of between 0.8 and 1.0, preferably of between 0.85 and 1.0, preferably of between 0.9 and 1.0, preferably of between 0.95 and 1.0, and more preferably of between at least 0.7 and 1.0;
ii) between 0.65 and 1.0, preferably of between 0.7 and 1.0, preferably of between 0.75 and 1.0, preferably of between 0.8 and 1.0, preferably of between 0.85 and 1.0, preferably of between 0.9 and 1.0, preferably of between 0.95 and 1.0, and more preferably of between 0.8 and 1.0;

wherein the 100/500-ratio is defined as the ratio of [trehalose activity at 100 mM glucose and 100 mM alpha-glucose-1 phosphate]/[trehalose activity at 500 mM glucose and 100 mM alpha-glucose-1 phosphate].

In a 104$^{th}$ embodiment of the first aspect which is also an embodiment of the 103$^{rd}$ embodiment of the first aspect, the polypeptide, preferably the trehalose phosphorylase, has thermal stability after incubation at 52° C. for 15 minutes defined by a residual activity of from 30% to 90%, preferably from 39% to 90%, more preferably from 42% to 90%, more preferably from 54% to 90%, more preferably from 55% to 90%, and even more preferably from 63% to 90%, even more preferably from 64% to 90%, even more preferably from 68% to 90%, and most preferably from 64% to 86%; and/or from 30% to 90%, preferably from 31% to 90%, preferably from 32% to 90%, preferably from 33% to 90%, preferably from 34% to 90%, preferably from 35% to 90%, preferably from 36% to 90%, preferably from 37% to 90%, preferably from 38% to 90%, preferably from 39% to 90%, more preferably from 40% to 90%, more preferably from 41% to 90%, more preferably from 42% to 90%, more preferably from 43% to 90%, more preferably from 44% to 90%, more preferably from 45% to 90%, more preferably from 46% to 90%, more preferably from 47% to 90%, more preferably from 48% to 90%, more preferably from 49% to 90%, even more preferably from 50% to 90%, even more preferably from 51% to 90%, even more preferably from 52% to 90%, even more preferably from 53% to 90%, even more preferably from 54% to 90%, even more preferably from 55% to 90%, even more preferably from 60% to 90%, even more preferably from 61% to 90%, even more preferably from 65% to 90%, even more preferably from 70% to 90%, even more preferably from 75% to 90%, and most preferably from 72% to 81%, and/or from 55% to 100%, preferably from 60% to 100%, preferably from 70% to 100%, preferably from 75% to 100%, preferably from 76% to 100%, preferably from 77% to 100%, preferably from 78% to 100%, preferably from 79% to 100%, more preferably from 80% to 100%, more preferably from 81% to 100%, more preferably from 82% to 100%, more preferably from 83% to 100%, more preferably from 84% to 100%, more preferably from 85% to 100%, more preferably from 86% to 100%, more preferably from 87% to 100%, more preferably from 88% to 100%, more preferably from 89% to 100%, even more preferably from 90% to 100%, even more preferably from 91% to 100%, even more preferably from 92% to 100%, even more preferably from 93% to 100%, even more preferably from 94% to 100%, even more preferably from 95% to 100%, even more preferably from 96% to 100%, even more preferably from 97% to 100%, even more preferably from 98% to 100%, even more preferably from 99% to 100%, and most preferably 100%.

In a 105$^{th}$ embodiment of the first aspect which is also an embodiment of the 103$^{rd}$ and 104$^{th}$ embodiment of the first aspect, the polypeptide, preferably the trehalose phosphorylase, has thermal stability characterized by a Tm30-value of at least 52° C.

In a 106$^{th}$ embodiment of the first aspect which is also an embodiment of the 103$^{rd}$, 104$^{th}$ and 105$^{th}$ embodiment of the first aspect, the polypeptide, preferably the trehalose phosphorylase, has a half-life at 45° C. of from 3 hours to 9 days or more, preferably of from 24 hours to 9 days or more, preferably of from 39 hours to 9 days or more, preferably of from 2 days to 9 days or more, more preferably of from 4 day to 9 days or more, more preferably of from 5.5 days to 9 days or more, more preferably of from 7 days to 9 days or more, even more preferably of at least 9 days or more, and most preferably of 9 days.

In a 107$^{th}$ embodiment of the first aspect which is also an embodiment of the 103$^{rd}$, 104$^{th}$, 105$^{th}$ and 106$^{th}$ embodiment of the first aspect, the polypeptide, preferably the trehalose phosphorylase, has relative activity expressed as 100/500-ratio of between 0.65 and 1.0, preferably of between 0.7 and 1.0, preferably of between 0.75 and 1.0, preferably of between 0.8 and 1.0, preferably of between 0.85 and 1.0, preferably of between 0.9 and 1.0, preferably of between 0.95 and 1.0, and more preferably of between 0.7 and 1.0.

In a 108$^{th}$ embodiment of the first aspect which is also an embodiment of the 103$^{rd}$, 104$^{th}$, 105$^{th}$, 106$^{th}$ and 107$^{th}$ embodiment of the first aspect, wherein the polypeptide is any one of the 26$^{th}$, 27$^{th}$, 28$^{th}$, 29$^{th}$, 30$^{th}$, 33$^{rd}$, 34$^{th}$, 41$^{st}$, 42$^{nd}$, 43$^{rd}$, 44$^{th}$, 45$^{th}$, 46$^{th}$, 55$^{th}$, 67$^{th}$, 68$^{th}$, 75$^{th}$, 76$^{th}$, 77$^{th}$, 78$^{th}$, 79$^{th}$, 80$^{th}$, 81$^{st}$, 84$^{th}$, 88$^{th}$, 89$^{th}$, 92$^{nd}$, 99$^{th}$, 100$^{th}$ and 102$^{nd}$ embodiment or of any other of the previous embodiments of the first aspect, preferably any one of the 26$^{th}$, 27$^{th}$, 28$^{th}$ 29$^{th}$, 30$^{th}$, 33$^{rd}$, 55$^{th}$, 67$^{th}$, 68$^{th}$, 75$^{th}$, 76$^{th}$, 77$^{th}$, 78$^{th}$, 79$^{th}$, 80$^{th}$81$^{st}$, 84$^{th}$, 88$^{th}$, 89$^{th}$, 92$^{nd}$, 99$^{th}$, 100$^{th}$ and 102$^{nd}$ embodiment of the first aspect.

In a 109$^{th}$ embodiment of the first aspect which is also an embodiment of the 103$^{rd}$ embodiment of the first aspect, the polypeptide, preferably the trehalose phosphorylase, has thermal stability after incubation at 52° C. for 15 minutes defined by a residual activity of from 30% to 90%, preferably from 31% to 90%, preferably from 32% to 90%, preferably from 33% to 90%, preferably from 34% to 90%, preferably from 35% to 90%, preferably from 36% to 90%, preferably from 37% to 90%, preferably from 38% to 90%, preferably from 39% to 90%, more preferably from 40% to 90%, more preferably from 41% to 90%, more preferably from 42% to 90%, more preferably from 43% to 90%, more preferably from 44% to 90%, more preferably from 45% to 90%, more preferably from 46% to 90%, more preferably from 47% to 90%, more preferably from 48% to 90%, more preferably from 49% to 90%, even more preferably from 50% to 90%, even more preferably from 51% to 90%, even more preferably from 52% to 90%, even more preferably from 53% to 90%, even more preferably from 54% to 90%, even more preferably from 60% to 90%, even more preferably from 61% to 90%, even more preferably from 65% to 90%, even more preferably from 70% to 90%, even more preferably from 75% to 90%, and most preferably from 72% to 81%, and/or from 55% to 100%, preferably from 60% to 100%, preferably from 70% to 100%, preferably from 75% to 100%, preferably from 76% to 100%, preferably from 77% to 100%, preferably from 78% to 100%, preferably from 79% to 100%, more preferably from 80% to 100%, more preferably from 81% to 100%, more preferably from 82% to 100%, more preferably from 83% to 100%, more preferably from 84% to 100%, more preferably from 85% to 100%, more preferably from 86% to 100%, more preferably from 87% to 100%, more preferably from 88% to 100%, more preferably from 89% to 100%, even more preferably from 90% to 100%, even more preferably from 91% to 100%, even more preferably from 92% to 100%, even more preferably from 93% to 100%, even more preferably from 94% to 100%, even more preferably from 95% to 100%, even more preferably from 96% to 100%, even more preferably from 97% to 100%, even more preferably from 98% to 100%, even more preferably from 99% to 100%, and most preferably 100%.

In a 110$^{th}$ embodiment of the first aspect which is also an embodiment of the 103$^{rd}$, 104$^{th}$, 105$^{th}$, 106$^{th}$, 107$^{th}$, 108$^{th}$ and 109$^{th}$ embodiment of the first aspect, the polypeptide, preferably the trehalose phosphorylase, has thermal stability characterized by a Tm30-value of at least 52° C. and/or a Tm50-value of at least 52° C.

In a 111$^{th}$ embodiment of the first aspect which is also an embodiment of the 103$^{rd}$, 104$^{th}$, 105$^{th}$, 106$^{th}$, 107$^{th}$, 108$^{th}$, 109$^{th}$ and 110$^{th}$ embodiment of the first aspect, the polypeptide, preferably the trehalose phosphorylase, has a half-life at 45° C. of from 1 day to 9 days, more preferably of from 2 days to 9 days, more preferably of from 4 days to 9 days, more preferably of from 5.5 days to 9 days, more preferably of from 7 days to 9 days, most preferably of 9 days.

In a 112$^{th}$ embodiment of the first aspect which is also an embodiment of the 103$^{rd}$, 104$^{th}$, 105$^{th}$, 106$^{th}$, 107$^{th}$, 108$^{th}$, 109$^{th}$, 110$^{th}$ and 111$^{th}$ embodiment of the first aspect, the polypeptide, preferably the trehalose phosphorylase, has relative activity expressed as 100/500-ratio of between 0.65 and 1.0, preferably of between 0.7 and 1.0, preferably of between 0.75 and 1.0, preferably of between 0.8 and 1.0, preferably of between 0.85 and 1.0, preferably of between 0.9 and 1.0, preferably of between 0.95 and 1.0, and more preferably of between 0.7 and 1.0.

In a 113$^{th}$ embodiment of the first aspect which is also an embodiment of the 109$^{th}$, 110$^{th}$, 111$^{th}$ and 112$^{th}$ embodiment of the first aspect, the polypeptide, preferably the trehalose phosphorylase, is one of the 27$^{th}$, 28$^{th}$, 29$^{th}$, 31$^{st}$, 35$^{th}$, 36$^{th}$, 41$^{st}$, 42$^{nd}$, 43$^{rd}$, 44$^{th}$, 45$^{th}$, 46$^{th}$, 57$^{th}$, 69$^{th}$, 70$^{th}$, 75$^{th}$, 76$^{th}$77$^{th}$, 78$^{th}$, 79$^{th}$, 80$^{th}$, 82$^{nd}$, 84$^{th}$88$^{th}$, 90$^{th}$, 93$^{rd}$, 99$^{th}$, 100$^{th}$ and 102$^{nd}$, or of any other of the previous embodiments of the first aspect, preferably any one of the 27$^{th}$, 28$^{th}$, 29$^{th}$, 31$^{st}$, 35$^{th}$, 36$^{th}$, 57$^{th}$, 69$^{th}$, 70$^{th}$, 75$^{th}$, 76$^{th}$, 77$^{th}$78$^{th}$, 79$^{th}$, 80$^{th}$, 82$^{nd}$, 84$^{th}$, 88$^{th}$, 90$^{th}$, 93$^{rd}$, 99$^{th}$, 100$^{th}$ and 102$^{nd}$ embodiment of the first aspect.

In a 114$^{th}$ embodiment of the first aspect which is also an embodiment of the 113$^{th}$ embodiment of the first aspect, the polypeptide, the polypeptide, preferably the trehalose phosphorylase, has thermal stability after incubation at 52° C. for 15 minutes defined by a residual activity from 55% from to 100%, preferably from 60% to 100%, preferably from 70% to 100%, preferably from 75% to 100%, preferably from 76% to 100%, preferably from 77% to 100%, preferably from 78% to 100%, preferably from 79% to 100%, more preferably from 80% to 100%, more preferably from 81% to 100%, more preferably from 82% to 100%, more preferably from 83% to 100%, more preferably from 84% to 100%, more preferably from 85% to 100%, more preferably from 86% to 100%, more preferably from 87% to 100%, more preferably from 88% to 100%, more preferably from 89% to 100%, even more preferably from 90% to 100%, even more preferably from 91% to 100%, even more preferably from 92% to 100%, even more preferably from 93% to 100%, even more preferably from 94% to 100%, even more preferably from 95% to 100%, even more preferably from 96% to 100%, even more preferably from 97% to 100%, even more preferably from 98% to 100%, even more preferably from 99% to 100%, and most preferably of 100%.

In a 115$^{th}$ embodiment of the first aspect which is also an embodiment of the 103$^{rd}$, 104$^{th}$, 105$^{th}$, 106$^{th}$, 107$^{th}$, 108$^{th}$, 109$^{th}$, 110$^{th}$, 111$^{th}$, 112$^{th}$, 113$^{th}$ and 114$^{th}$ embodiment of the first aspect, the polypeptide, preferably the trehalose phosphorylase, has thermal stability characterized by a Tm30-value of at least 52° C. and/or a Tm50-value of at least 52° C., and which is preferably characterized by a Tm30-value of a at least 52° C. and a Tm50-value of at least 52° C.

In a 116$^{th}$ embodiment of the first aspect which is also an embodiment of the 103$^{rd}$, 104$^{th}$, 105$^{th}$, 106$^{th}$, 107$^{th}$, 108$^{th}$, 109$^{th}$, 110$^{th}$, 111$^{th}$, 112$^{th}$, 113$^{th}$, 114$^{th}$ and 115$^{th}$ embodiment of the first aspect, the polypeptide, preferably the trehalose phosphorylase has thermal stability characterized by i) a Tm30-between 52° C. and 90° C., preferably between 52° C. and 80° C., preferably between a 52.5° C. and 80° C., preferably between 53° C. and 80° C., preferably between 53.5° C. and 80° C., more preferably between 54° C. and 80° C., preferably between 54.5° C. and 80° C., even more preferably between 55° C. and 80° C., preferably between 55.5° C. and 80° C., preferably between 56° C. and 80° C., preferably between 56.5° C. and 80° C., preferably between 57° C. and 80° C., preferably between 57.5° C. and 80° C., preferably between 58° C. and 80° C., preferably between 58.5° C. and 80° C., even more preferably between 52° C. and 70° C., even more preferably between 52.5° C. and 70° C., even more preferably between 53° C. and 70° C., even more preferably between 53.5° C. and 70° C., more even more preferably between 54° C. and 70° C., even more preferably between 54.5° C. and 70° C., even more even more preferably between 55° C. and 70° C., even more preferably between 55.5° C. and 70° C., even more preferably between 56° C. and 70° C., even more preferably between 56.5° C. and 70° C., even more preferably between 57° C. and 70° C., even more preferably between 57.5° C. and 70° C., even more preferably between 58° C. and 70° C., even more preferably between 58.5° C. and 70° C., even more preferably between 52° C. and 65° C., even more preferably between 52.5° C. and 65° C., even more preferably between 53° C. and 65° C., even more preferably between 53.5° C. and 65° C., more even more preferably between 54° C. and 65° C., even more preferably between 54.5° C. and 65° C., even more even more preferably between 55° C. and 65° C., even more preferably between 55.5° C. and 65° C., even more preferably between 56° C. and 65° C., even more preferably between 56.5° C. and 65° C., even more preferably between 57° C. and 65° C., even more preferably between 57.5° C. and 65° C., even more preferably between 58° C. and 65° C., even more preferably between 58.5° C. and 65° C., even more preferably between 52° C. and 60° C., even more preferably between 52.5° C. and 60° C., even more preferably between 53° C. and 60° C., even more preferably between 53.5° C. and 60° C., more even more preferably between from 54° C. and 60° C., even more preferably between from 54.5° C. and 60° C., even more even more preferably between 55° C. and 60° C., even more preferably between 55.5° C. and 60° C., even more preferably between 56° C. and 60° C., even more preferably between 56.5° C. and 60° C., even more preferably between 57° C. and 60° C., even more preferably between 57.5° C. and 60° C., even more preferably between 58° C. and 60° C., even more preferably between 58.5° C. and 60° C., and most preferably between 53.5° C. and 58.5° C. and/or ii) a Tm50-value between 52° C. and 90° C., preferably between 52° C. and 80° C., preferably between 52.5° C. and 80° C., preferably between 53° C. and 80° C., preferably between 53.5° C. and 80° C., more preferably between 54° C. and 80° C., preferably between 54.5° C. and 80° C., even more preferably between 55° C. and 80° C., preferably between 55.5° C. and 80° C., preferably between 56° C. and 80° C., preferably between 56.5° C. and 80° C., preferably between 57° C. and 80° C., preferably between 57.5° C. and 80° C., even more preferably between 52° C. and 70° C., even more preferably between 52.5° C. and 70° C., even more preferably between 53° C. and 70° C., even more preferably between 53.5° C. and 70° C., more even more preferably between 54° C. and 70° C., even more preferably between 54.5° C. and 70° C., even more preferably between 55° C. and 70° C., even more preferably between 55.5° C. and 70° C., even more preferably between 56° C. and 70° C., even more preferably between 56.5° C. and 70° C., even more preferably between 57° C. and 70° C., even more preferably between 57.5° C. and 70° C., even more preferably between 52° C. and 65° C., even more preferably between 52.5° C. and 65° C., even more preferably between 53° C. and 65° C., even more preferably between 53.5° C. and 65° C., more even more preferably between 54° C. and 65° C., even more preferably between 54.5° C. and 65° C., even more even more preferably between 55° C. and 65° C., even more preferably between 55.5° C. and 65° C., even more preferably between 56° C. and 65° C., even more preferably between 56.5° C. and 65° C., even more preferably between 57° C. and 65° C., even more preferably between 57.5° C. and 65° C., even more preferably between 52° C. and 60° C., even more preferably between 52.5° C. and 60° C., even more preferably between 53° C. and 60° C., even more preferably between 53.5° C. and 60° C., more even more preferably between 54° C. and 60° C., even more preferably between 54.5° C. and 60° C., even more preferably between 55° C. and 60° C., even more preferably between 55.5° C. and 60° C., even more preferably between 56° C. and 60° C., even more preferably between 56.5° C. and 60° C., even more preferably between 57° C. and 60° C., even more preferably between 57.5° C. and 60° C., and most preferably between 52° C. and 57.5° C.

In a $117^{th}$ embodiment of the first aspect which is also an embodiment of the $103^{rd}$, $104^{th}$, $105^{th}$, $106^{th}$, $107^{th}$, $108^{th}$, $109^{th}$, $110^{th}$, $111^{th}$, $112^{th}$, $113^{th}$, $114^{th}$, $115^{th}$ and $116^{th}$ embodiment of the first aspect, wherein the polypeptide, preferably the trehalose phosphorylase has a half-life at 45° C. of from 4 days to 9 days or more, preferably of from 5.5 days to 9 days or more, more preferably of from 7 days up to 9 days or more, even more preferably of at least 9 days or more, and most preferably of 9 days.

In a $118^{th}$ embodiment of the first aspect which is also an embodiment of the $103^{rd}$, $104^{th}$, $105^{th}$, $106^{th}$, $107^{th}$, $108^{th}$, $109^{th}$, $110^{th}$, $111^{th}$, $112^{th}$, $113^{th}$, $114^{th}$, $115^{th}$, $116^{th}$ and $117^{th}$ embodiment of the first aspect, the polypeptide, preferably the trehalose phosphorylase has a relative activity expressed as 100/500-ratio of between 0.65 and 1.0, preferably of between 0.7 and 1.0, preferably of between 0.75 and 1.0, preferably of between 0.8 and 1.0, preferably of between 0.85 and 1.0, preferably of between 0.9 and 1.0, preferably of between 0.95 and 1.0, and more preferably of between 0.8 and 1.0.

In a $119^{th}$ embodiment of the first aspect which is also an embodiment of the $114^{th}$, $115^{th}$, $116^{th}$, $117^{th}$ embodiment of the first aspect, wherein the polypeptide, preferably the trehalose phosphorylase, is any one of the $28^{th}$, $29^{th}$, $32^{nd}$, $37^{th}$, $38^{th}$, $39^{th}$, $40^{th}$, $41^{st}$, $42^{nd}$, $43^{rd}$, $44^{th}$, $45^{th}$, $46^{th}$, $59^{th}$, $60^{th}$, $61^{st}$, $62^{nd}$, $71^{st}$, $72^{nd}$, $73^{rd}$, $74^{th}$, $75^{th}$, $76^{th}$, $77^{th}$, $78^{th}$, $79^{th}$, $80^{th}$, $82^{nd}$, $84^{th}$, $88^{th}$, $91^{st}$, $94^{th}$, $99^{th}$, $100^{th}$ and $102^{nd}$ or of any other of the previous embodiments of the first aspect, preferably any one of embodiments $28^{th}$, $29^{th}$, $32^{nd}$, $37^{th}$, $38^{th}$, $39^{th}$, $40^{th}$, $59^{th}$, $60^{th}$, $61^{st}$, $62^{nd}$, $71^{st}$, $72^{nd}$, $73^{rd}$, $74^{th}$, $75^{th}$, $76^{th}$, $77^{th}$, $78^{th}$, $79^{th}$, $80^{th}$, $82^{nd}$, $84^{th}$, $88^{th}$, $91^{st}$, $94^{th}$, $99^{th}$, $100^{th}$ and $102^{nd}$ embodiment of the first aspect.

In a $120^{th}$ embodiment of the first aspect which is also an embodiment of the first, second, third, fourth, fifth, sixth, seventh, eighth, ninth, tenth, eleventh, twelfth, $13^{th}$, $14^{th}$, $15^{th}$, $16^{th}$, $17^{th}$, $18^{th}$, $19^{th}$, $20^{th}$, $21^{st}$, $22^{nd}$, $23^{rd}$, $24^{th}$, $25^{th}$, $26^{th}$, $27^{th}$, $28^{th}$, $29^{th}$, $30^{th}$, $31^{st}$, $32^{nd}$, $33^{rd}$, $34^{th}$, $35^{th}$, $36^{th}$, $37^{th}$, $38^{th}$, $39^{th}$, $40^{th}$, $41^{st}$, $42^{nd}$, $43^{rd}$, $44^{th}$, $45^{th}$, $46^{th}$, $47^{th}$, $48^{th}$, $49^{th}$, $50^{th}$, $51^{st}$, $52^{nd}$, $53^{rd}$, $54^{th}$, $55^{th}$, $56^{th}$ $57^{th}$, $58^{th}$, $59^{th}$, $60^{th}$, $61^{st}$, $62^{nd}$, $63^{rd}$, $64^{th}$, $65^{th}$, $66^{th}$, $67^{th}$, $68^{th}$, $69^{th}$, $70^{th}$, $71^{st}$, $72^{nd}$, $73^{rd}$, $74^{th}$, $75^{th}$, $76^{th}$, $77^{th}$, $78^{th}$, $79^{th}$, $80^{th}$, $81^{st}$, $82^{nd}$, $83^{rd}$, $84^{th}$, $85^{th}$, $86^{th}$, $87^{th}$, $88^{th}$, $89^{th}$, $90^{th}$, $91^{st}$, $92^{nd}$, $93^{rd}$, $94^{th}$, $95^{th}$, $96^{th}$, $97^{th}$, $98^{th}$, $99^{th}$, $100^{th}$, $101^{st}$ and $102^{nd}$, $103^{rd}$, $104^{th}$, $105^{th}$, $106^{th}$, $107^{th}$, $108^{th}$, $109^{th}$, $110^{th}$, $111^{th}$, $112^{th}$, $113^{th}$, $114^{th}$, $115^{th}$, $116^{th}$, $117^{th}$, $118^{th}$ and $119^{th}$ embodiment or of any other of the previous embodiments of the first aspect, preferably any one of the $28^{th}$, $29^{th}$, $32^{nd}$, $37^{th}$, $38^{th}$, $39^{th}$, $40^{th}$, $41^{st}$, $42^{nd}$, $43^{rd}$, $44^{th}$, $45^{th}$, $46^{th}$, $59^{th}$, $60^{th}$, $61^{st}$, $62^{nd}$, $71^{st}$, $72^{nd}$, $73^{rd}$, $74^{th}$, $75^{th}$, $76^{th}$, $77^{th}$, $78^{th}$, $79^{th}$, $80^{th}$, $82^{nd}$, $84^{th}$, $88^{th}$, $91^{st}$, $94^{th}$, $99^{th}$, $100^{th}$ and $102^{nd}$ embodiment of the first aspect, more preferably any one of the $29^{th}$, $32^{nd}$ $37^{th}$, $38^{th}$, $39^{th}$, $40^{th}$, $59^{th}$, $60^{th}$, $61^{st}$, $62^{nd}$, $71^{st}$, $72^{nd}$ $73^{rd}$, $74^{th}$, $75^{th}$, $76^{th}$, $77^{th}$, $78^{th}$, $79^{th}$, $80^{th}$, $82^{nd}$, $84^{th}$ $88^{th}$, $91^{st}$, $94^{th}$, $99^{th}$, $100^{th}$ and $102^{nd}$ embodiment of the first aspect, wherein the polymerase, preferably the trehalose phosphorylase, compared to a trehalose phosphorylase of SEQ ID NO:1, is characterized by an increase in thermal stability, whereby the increase in thermal stability is i) an increase of the Tm30-value of at least 2° C. up to 40.5° C., preferably 2° C. up to 30.5° C., preferably of at least 2.5° C. up to 30.5° C., preferably of at least 3° C. up to 30.5° C., preferably of at least 3.5° C. up to 30.5° C., preferably of at least 4° C. up to 30.5° C., preferably of at least 4.5° C. up to 30.5° C., preferably of at least 5° C. up to 30.5° C., preferably of at least 5.5° C. up to 30.5° C., preferably of at least 6° C. up to 30.5° C., preferably of at least 6.5° C. up to 30.5° C., preferably of at least 7° C. up to 30.5° C., preferably of at least 7.5° C. up to 30.5° C., preferably of at least 8° C. up to 30.5° C., preferably of at least 8.5° C. up to 30.5° C., preferably of at least 9° C. up to 30.5° C., more preferably 2° C. up to 20.5° C., more preferably of at least 2.5° C. up to 20.5° C., more preferably of at least 3° C. up to 20.5° C., more preferably of at least 3.5° C. up to 20.5° C., more preferably of at least 4° C. up to 20.5° C., more preferably of at least 4.5° C. up to 20.5° C., more preferably of at least 5° C. up to 20.5° C., more preferably of at least 5.5° C. up to 20.5° C., more preferably of at least 6° C. up to 20.5° C., more preferably of at least 6.5° C. up to 20.5° C., more preferably of at least 7° C. up to 20.5° C., more preferably of at least 7.5° C. up to 20.5° C., more preferably of at least 8° C. up to 20.5° C., more preferably of at least 8.5° C. up to 20.5° C., more preferably of at least 9° C. up to 20.5° C., even more preferably 2° C. up to 15.5° C., even more preferably of at least 2.5° C. up to 15.5° C., even more preferably of at least 3° C. up to 15.5° C., even more preferably of at least 3.5° C. up to 15.5° C., even more preferably of at least 4° C. up to 15.5° C., even more preferably of at least 4.5° C. up to 15.5° C., even more preferably of at least 5° C. up to 15.5° C., even more preferably of at least 5.5° C. up to 15.5° C., even more preferably of at least 6° C. up to 15.5° C., even more preferably of at least 6.5° C. up to 15.5° C., even more preferably of at least 7° C. up to 15.5° C., even more preferably of at least 7.5° C. up to 15.5° C., even more preferably of at least 8° C. up to 15.5° C., even more preferably of at least 8.5° C. up to 15.5° C., even more preferably of at least 9° C. up to 15.5° C., even more preferably 2° C. up to 10.5° C., even more preferably of at least 2.5° C. up to 10.5° C., even more preferably of at least 3° C. up to 10.5° C., even more preferably of at least 3.5° C. up to 10.5° C., even more preferably of at least 4° C. up to 10.5° C., even more preferably of at least 4.5° C. up to 10.5° C., even more preferably of at least 5° C. up to 10.5° C., even more preferably of at least 5.5° C. up to 10.5° C., even more preferably of at least 6° C. up to 10.5° C., even more preferably of at least 6.5° C. up to 10.5° C., even more preferably of at least 7° C. up to 10.5° C., even more preferably of at least 7.5° C. up to 10.5° C., even more preferably of at least 8° C. up to 10.5° C., even more preferably of at least 8.5° C. up to 10.5° C., even more preferably of at least 9° C. up to 10.5° C., and most preferably by at least 4° C. up to 9° C.; and/or ii) an increase of the Tm50-value of at least 2° C. up to 42.5° C., preferably 2° C. up to 32.5° C., preferably of at least 2.5° C. up to 32.5° C., preferably of at least 3° C. up to 32.5° C., preferably of at least 3.5° C. up to 32.5° C., preferably of at least 4° C. up to 32.5° C., preferably of at least 4.5° C. up to 32.5° C., preferably of at least 5° C. up to 32.5° C., preferably of at least 5.5° C. up to 32.5° C., preferably of at least 6° C. up to 32.5° C., preferably of at least 6.5° C. up to 32.5° C., preferably of at least 7° C. up to 32.5° C., preferably of at least 7.5° C. up to 32.5° C., preferably of at least 8° C. up to 32.5° C., preferably of at least 8.5° C. up to 32.5° C., preferably of at least 9° C. up to 32.5° C., preferably of at least 9.5° C. up to 32.5° C., preferably of at least 10° C. up to 32.5° C., more preferably 2° C. up to 22.5° C., more preferably of at least 2.5° C. up to 22.5° C., more preferably of at least 3° C. up to 22.5° C., more preferably of at least 3.5° C. up to 22.5° C., more preferably of at least 4° C. up to 22.5° C., more preferably of at least 4.5° C. up to 22.5° C., more preferably of at least 5° C. up to 22.5° C., more preferably of at least 5.5° C. up to 22.5° C., more preferably of at least 6° C. up to 22.5° C., more preferably of at least 6.5° C. up to 22.5° C., more preferably of at least 7° C. up to 22.5° C., more preferably of at least 7.5° C. up to 22.5° C., more preferably of at least 8° C. up to 22.5° C., more preferably of at least 8.5° C. up to 22.5° C., more preferably of at least 9° C. up to 22.5° C., more preferably of at least 9.5° C. up to 22.5° C., more preferably of at least 10° C. up to 22.5° C., even more preferably 2° C. up to 17.5° C., even more preferably of at least 2.5° C. up to 17.5° C., even more preferably of at least 3° C. up to 17.5° C., even more preferably of at least 3.5° C. up to 17.5° C., even more preferably of at least 4° C. up to 17.5° C., even more preferably of at least 4.5° C. up to 17.5° C., even more preferably of at least 5° C. up to 17.5° C., even more preferably of at least 5.5° C. up to 17.5° C., even more preferably of at least 6° C. up to 17.5° C., even more preferably of at least 6.5° C. up to 17.5° C., even more preferably of at least 7° C. up to 17.5° C., even more preferably of at least 7.5° C. up to 17.5° C., even more preferably of at least 8° C. up to 17.5° C., even more preferably of at least 8.5° C. up to 17.5° C., even more preferably of at least 9° C. up to 17.5° C., even more preferably of at least 9.5° C. up to 17.5° C., even more preferably of at least 10° C. up to 17.5° C., even more preferably 2° C. up to 12.5° C., even more preferably of at least 2.5° C. up to 12.5° C., even more preferably of at least 3° C. up to 12.5° C., even more preferably of at least 3.5° C. up to 12.5° C., even more preferably of at least 4° C. up to 12.5° C., even more preferably of at least 4.5° C. up to 12.5° C., even more preferably of at least 5° C. up to 12.5° C., even more preferably of at least 5.5° C. up to 12.5° C., even more preferably of at least 6° C. up to 12.5° C., even more preferably of at least 6.5° C. up to 12.5° C., even more preferably of at least 7° C. up to 12.5° C., even more preferably of at least 7.5° C. up to 12.5° C., even more preferably of at least 8° C. up to 12.5° C., even more preferably of at least 8.5° C. up to 12.5° C., even more preferably of at least 9° C. up to 12.5° C., even more preferably of at least 9.5° C. up to 12.5° C., even more preferably of at least 10° C. up to 12.5° C., and most preferably by at least 4° C. up to 9° C.; and/or iii) an improved process stability, characterized by an increased half-life at 45° C. of
  i) at least 3-fold up to 216-fold or more, preferably of at least 24-fold up to 216-fold or more, preferably of at least 39-fold up to 216-fold or more, preferably of at least 48-fold up to 216-fold or more, preferably of at least 96-fold up to 216-fold or more, preferably of at least 132-fold up to 216-fold or more, more preferably of at least 216-fold or more, and most preferably of 216-fold;
  ii) at least 24-fold up to 216-fold or more, preferably of at least 39-fold up to 216-fold or more, preferably of at least 48-fold up to 216-fold or more, preferably of at least 96-fold up to 216-fold or more, preferably of at least 132-fold up to 216-fold or more, more preferably of at least 216-fold or more, and most preferably of 216-fold;
  iii) at least 96-fold up to 216-fold or more, preferably of at least 132-fold up to 216-fold or more, more preferably of at least 216-fold or more, and most preferably of 216-fold.

More specifically, these and other problems are solved in a second aspect, which is also the first embodiment of the second aspect, by a polypeptide, preferably a trehalose phosphorylase, comprising an amino acid sequence, wherein the amino acid sequence of the polypeptide, preferably of the trehalose phosphorylase, is at least 80% identical to and/or at least 80% homologous to an amino acid sequence of SEQ ID NO: 1, wherein the polypeptide, preferably trehalose phosphorylase, has at least one of characteristics (A), (B), (C), (D) and (E), or any combination thereof, wherein characteristic (A) is thermal stability after incubation at 52° C. for 15 minutes defined by a residual activity of
  i) from 30% to 90%, preferably from 39% to 90%, more preferably from 42% to 90%, more preferably from 54% to 90%, more preferably from 55% to 90%, and even more preferably from 63% to 90%, even more preferably from 64% to 90%, even more preferably from 68% to 90%, and most preferably from 64% to 86%, and/or
  ii) from 30% to 90%, preferably from 31% to 90%, preferably from 32% to 90%, preferably from 33% to 90%, preferably from 34% to 90%, preferably from 35% to 90%, preferably from 36% to 90%, preferably from 37% to 90%, preferably from 38% to 90%, preferably from 39% to 90%, more preferably from 40% to 90%, more preferably from 41% to 90%, more preferably from 42% to 90%, more preferably from 43% to 90%, more preferably from 44% to 90%, more preferably from 45% to 90%, more preferably from 46% to 90%, more preferably from 47% to 90%, more preferably from 48% to 90%, more preferably from 49% to 90%, even more preferably from 50% to 90%, even more preferably from 51% to 90%, even more preferably from 52% to 90%, even more preferably from 53% to 90%, even more preferably from 54% to 90%, even more preferably from 55% to 90%, even more preferably from 60% to 90%, even more preferably from 61% to 90%, even more preferably from 65% to 90%, even more preferably from 70% to 90%, even more preferably from 75% to 90%, and most preferably from 72% to 81%, and/or
  iii) from 55% to 100%, preferably from 60% to 100%, preferably from 70% to 100%, preferably from 75% to 100%, preferably from 76% to 100%, preferably from 77% to 100%, preferably from 78% to 100%, preferably from 79% to 100%, more preferably from 80% to 100%, more preferably from 81% to 100%, more preferably from 82% to 100%, more preferably from 83% to 100%, more preferably from 84% to 100%, more preferably from 85% to 100%, more preferably from 86% to 100%, more preferably from 87% to 100%, more preferably from 88% to 100%, more preferably from 89% to 100%, even more preferably from 90% to 100%, even more preferably from 91% to 100%, even more preferably from 92% to 100%, even more preferably from 93% to 100%, even more preferably from 94% to 100%, even more preferably from 95% to 100%, even more preferably from 96% to 100%, even more preferably from 97% to 100%, even more preferably from 98% to 100%, even more preferably from 99% to 100%, and most preferably 100%, and wherein characteristic (B) is thermal stability after incubation at 52° C. for 15 minutes which is characterized by
  i) a Tm30-value of at least 52° C., and/or
  ii) a Tm50-value of at least 52° C.,
and wherein characteristic (C) is thermal stability characterized by
  i) a Tm30-value between 52° C. and 90° C., preferably between 52° C. and 80° C., preferably between 52.5° C. and 80° C., preferably between 53° C. and 80° C., preferably between 53.5° C. and 80° C., more preferably between 54° C. and 80° C., preferably between 54.5° C. and 80° C., even more preferably between 55° C. and 80° C., preferably between 55.5° C. and 80° C., preferably between 56° C. and 80° C., preferably between 56.5° C. and 80° C., preferably between 57° C. and 80° C., preferably between 57.5° C. and 80° C., preferably between 58° C. and 80° C., preferably between 58.5° C. and 80° C., even more preferably between 52° C. and 70° C., even more preferably between 52.5° C. and 70° C., even more preferably between 53° C. and 70° C., even more preferably between 53.5° C. and 70° C., more even more preferably between 54° C. and 70° C., even more preferably between 54.5° C. and 70° C., even more even more preferably between 55° C. and 70° C., even more preferably between 55.5° C. and 70° C., even more preferably between 56° C. and 70° C., even more preferably between 56.5° C. and 70° C., even more preferably between 57° C. and 70° C., even more preferably between 57.5° C. and 70° C., even more preferably between 58° C. and 70° C., even more preferably between 58.5° C. and 70° C., even more preferably between 52° C. and 65° C., even more preferably between 52.5° C. and 65° C., even more preferably between 53° C. and 65° C., even more preferably between 53.5° C. and 65° C., more even more preferably between 54° C. and 65° C., even more preferably between 54.5° C. and 65° C., even even more preferably between 55° C. and 65° C., even more preferably between 55.5° C. and 65° C., even more preferably between 56° C. and 65° C., even more preferably between 56.5° C. and 65° C., even more preferably between 57° C. and 65° C., even more preferably between 57.5° C. and 65° C., even more preferably between 58° C. and 65° C., even more preferably between 58.5° C. and 65° C., even more preferably between 52° C. and 60° C., even more preferably between 52.5° C. and 60° C., even more preferably between 53° C. and 60° C., even more preferably between 53.5° C. and 60° C., more even more preferably between 54° C. and 60° C., even more preferably between 54.5° C. and 60° C., even even more preferably between 55° C. and 60° C., even more preferably between 55.5° C. and 60° C., even more preferably between 56° C. and 60° C., even more preferably between 56.5° C. and 60° C., even more preferably between 57° C. and 60° C., even more preferably between 57.5° C. and 60° C., even more preferably between 58° C. and 60° C., even more preferably between 58.5° C. and 60° C., and most preferably between 53.5° C. and 58.5° C. and/or
  ii) a Tm50-value between between 52° C. and 90° C., preferably between 52° C. and 80° C., preferably between 52.5° C. and 80° C., preferably between 53° C. and 80° C., preferably between 53.5° C. and 80° C., more preferably between 54° C. and 80° C., preferably between 54.5° C. and 80° C., even more preferably between 55° C. and 80° C., preferably between 55.5° C. and 80° C., preferably between 56° C. and 80° C., preferably between 56.5° C. and 80° C., preferably between 57° C. and 80° C., preferably between 57.5° C.

and 80° C., even more preferably between 52° C. and 70° C., even more preferably between 52.5° C. and 70° C., even more preferably between 53° C. and 70° C., even more preferably between 53.5° C. and 70° C., more even more preferably between 54° C. and 70° C., even more preferably between 54.5° C. and 70° C., even more even more preferably between 55° C. and 70° C., even more preferably between 55.5° C. and 70° C., even more preferably between 56° C. and 70° C., even more preferably between 56.5° C. and 70° C., even more preferably between 57° C. and 70° C., even more preferably between 57.5° C. and 70° C., even more preferably between 52° C. and 65° C., even more preferably between 52.5° C. and 65° C., even more preferably between 53° C. and 65° C., even more preferably between 53.5° C. and 65° C., more even more preferably between 54° C. and 65° C., even more preferably between 54.5° C. and 65° C., even more even more preferably between 55° C. and 65° C., even more preferably between 55.5° C. and 65° C., even more preferably between 56° C. and 65° C., even more preferably between 56.5° C. and 65° C., even more preferably between 57° C. and 65° C., even more preferably between 57.5° C. and 65° C., even more preferably between 52° C. and 60° C., even more preferably between 52.5° C. and 60° C., even more preferably between 53° C. and 60° C., even more preferably between 53.5° C. and 60° C., more even more preferably between 54° C. and 60° C., even more preferably between 54.5° C. and 60° C., even more even more preferably between 55° C. and 60° C., even more preferably between 55.5° C. and 60° C., even more preferably between 56° C. and 60° C., even more preferably between 56.5° C. and 60° C., even more preferably between 57° C. and 60° C., even more preferably between 57.5° C. and 60° C., and most preferably between 52° C. and 57.5° C.;

and wherein characteristic (D) is thermal stability characterized by i) a process stability, characterized by a half-life at 45° C. of from 3 hours to 9 days or more, preferably of from 24 hours to 9 days or more, preferably of from 39 hours to 9 days or more, preferably of from 2 days to 9 days or more, more preferably of from 4 days to 9 days or more, more preferably of from 5.5 days to 9 days or more, more preferably of from least 7 days to 9 days or more, even more preferably of at least 9 days or more, and most preferably of 9 days;

ii) a process stability, characterized by a half-life at 45° C. of from 24 hours to 9 days or more, more preferably of from 39 hours to 9 days or more, more preferably of from 2 days to 9 days or more, more preferably of from 4 days to 9 days or more, more preferably of from 5.5 days to 9 days or more, more preferably of from 7 days to 9 days or more, even more preferably of at least 9 days or more, and most preferably of 9 days;

iii) a process stability, characterized by a half-life at 45° C. of 4 days to 9 days or more, preferably of from 5.5 days up to 9 days or more, more preferably of from 7 days up to 9 days or more, even more preferably of at least 9 days or more, and most preferably of 9 days; and wherein characteristic (E) is relative activity expressed as 100/500-ratio of (i) between 0.65 and 1.0, preferably of between 0.7 and 1.0, preferably of between 0.75 and 1.0, preferably of between 0.8 and 1.0, preferably of between 0.85 and 1.0, preferably of between 0.9 and 1.0, preferably of between 0.95 and 1.0, and more preferably of between at least 0.7 and 1.0;

(ii) between 0.65 and 1.0, preferably of between 0.7 and 1.0, preferably of between 0.75 and 1.0, preferably of between 0.8 and 1.0, preferably of between 0.85 and 1.0, preferably of between 0.9 and 1.0, preferably of between 0.95 and 1.0, and more preferably of between 0.8 and 1.0;

wherein the 100/500-ratio is defined as the ratio of [trehalose activity at 100 mM glucose and 100 mM alpha-glucose-1 phosphate]/[trehalose activity at 500 mM glucose and 100 mM alpha-glucose-1 phosphate].

In a second embodiment of the second aspect which is also an embodiment of the first embodiment of the second aspect, the polypeptide, preferably the trehalose phosphorylase has thermal stability after incubation at 52° C. for 15 minutes defined by a residual activity of from 30% to 90%, preferably from 39% to 90%, more preferably from 42% to 90%, more preferably from 54% to 90%, more preferably from 55% to 90%, and even more preferably from 63% to 90%, even more preferably from 64% to 90%, even more preferably from 68% to 90%, and most preferably from 64% to 86%; and/or from 30% to 90%, preferably from 31% to 90%, preferably from 32% to 90%, preferably from 33% to 90%, preferably from 34% to 90%, preferably from 35% to 90%, preferably from 36% to 90%, preferably from 37% to 90%, preferably from 38% to 90%, preferably from 39% to 90%, more preferably from 40% to 90%, more preferably from 41% to 90%, more preferably from 42% to 90%, more preferably from 43% to 90%, more preferably from 44% to 90%, more preferably from 45% to 90%, more preferably from 46% to 90%, more preferably from 47% to 90%, more preferably from 48% to 90%, more preferably from 49% to 90%, even more preferably from 50% to 90%, even more preferably from 51% to 90%, even more preferably from 52% to 90%, even more preferably from 53% to 90%, even more preferably from 54% to 90%, even more preferably from 55% to 90%, even more preferably from 60% to 90%, even more preferably from 61% to 90%, even more preferably from 65% to 90%, even more preferably from 70% to 90%, even more preferably from 75% to 90%, and most preferably from 72% to 81%, and/or from 55% to 100%, preferably from 60% to 100%, preferably from 70% to 100%, preferably from 75% to 100%, preferably from 76% to 100%, preferably from 77% to 100%, preferably from 78% to 100%, preferably from 79% to 100%, more preferably from 80% to 100%, more preferably from 81% to 100%, more preferably from 82% to 100%, more preferably from 83% to 100%, more preferably from 84% to 100%, more preferably from 85% to 100%, more preferably from 86% to 100%, more preferably from 87% to 100%, more preferably from 88% to 100%, more preferably from 89% to 100%, even more preferably from 90% to 100%, even more preferably from 91% to 100%, even more preferably from 92% to 100%, even more preferably from 93% to 100%, even more preferably from 94% to 100%, even more preferably from 95% to 100%, even more preferably from 96% to 100%, even more preferably from 97% to 100%, even more preferably from 98% to 100%, even more preferably from 99% to 100%, and most preferably 100%.

In a third embodiment of the second aspect which is also an embodiment of the first and the second embodiment of the second aspect, wherein the polypeptide, preferably the trehalose phosphorylase, has thermal stability characterized by a Tm30-value of at least 52° C.

In a fourth embodiment of the second aspect which is also an embodiment of the first, second and third embodiment of the second aspect, the polypeptide, preferably the trehalose phosphorylase has a half-life at 45° C. of from 3 hours to 9 days or more, preferably of from 24 hours to 9 days or more, preferably of from 39 hours to 9 days or more, preferably of from 2 days to 9 days or more, more preferably of from 4 day to 9 days or more, more preferably of from 5.5 days to 9 days or more, more preferably of from 7 days to 9 days or more, even more preferably of at least 9 days or more, and most preferably of 9 days.

In a fifth embodiment of the second aspect which is also an embodiment of the first, second, third and fourth embodiment of the second aspect, the polypeptide, preferably the trehalose phosphorylase has relative activity expressed as 100/500-ratio of between 0.65 and 1.0, preferably of between 0.7 and 1.0, preferably of between 0.75 and 1.0, preferably of between 0.8 and 1.0, preferably of between 0.85 and 1.0, preferably of between 0.9 and 1.0, preferably of between 0.95 and 1.0, and more preferably of between 0.7 and 1.0.

In a sixth embodiment of the second aspect which is also an embodiment of the first, second, third, fourth and fifth embodiment of the second aspect, the polypeptide, preferably the trehalose phosphorylase is defined as in any one of embodiments 1 to 120 or of any other of the embodiments of the first aspect, preferably as defined in any one of embodiments 26, 27, 28, 29, 30, 33, 34, 41, 42, 43, 44, 45, 46, 55, 67, 68, 75, 76, 77, 78, 79, 80, 81, 84, 88, 89, 92, 99, 100 and 102 of the first aspect, preferably as defined in any one of embodiments 26, 27, 28, 29, 30, 33, 34, 55, 67, 68, 75, 76, 77, 78, 79, 80, 81, 84, 88, 89, 92, 99, 100 and 102 of the first aspect.

In a seventh embodiment of the second aspect which is also an embodiment of the first, second, third, fourth and fifth embodiment of the second aspect, the polypeptide, preferably the trehalose phosphorylase, has thermal stability after incubation at 52° C. for 15 minutes defined by a residual activity of
from 30% to 90%, preferably from 31% to 90%, preferably from 32% to 90%, preferably from 33% to 90%, preferably from 34% to 90%, preferably from 35% to 90%, preferably from 36% to 90%, preferably from 37% to 90%, preferably from 38% to 90%, preferably from 39% to 90%, more preferably from 40% to 90%, more preferably from 41% to 90%, more preferably from 42% to 90%, more preferably from 43% to 90%, more preferably from 44% to 90%, more preferably from 45% to 90%, more preferably from 46% to 90%, more preferably from 47% to 90%, more preferably from 48% to 90%, more preferably from 49% to 90%, even more preferably from 50% to 90%, even more preferably from 51% to 90%, even more preferably from 52% to 90%, even more preferably from 53% to 90%, even more preferably from 54% to 90%, even more preferably from 55% to 90%, even more preferably from 60% to 90%, even more preferably from 61% to 90%, even more preferably from 65% to 90%, even more preferably from 70% to 90%, even more preferably from 75% to 90%, and most preferably from 72% to 81%; and or
from 55% to 100%, preferably from 60% to 100%, preferably from 70% to 100%, preferably from 75% to 100%, preferably from 76% to 100%, preferably from 77% to 100%, preferably from 78% to 100%, preferably from 79% to 100%, more preferably from 80% to 100%, more preferably from 81% to 100%, more preferably from 82% to 100%, more preferably from 83% to 100%, more preferably from 84% to 100%, more preferably from 85% to 100%, more preferably from 86% to 100%, more preferably from 87% to 100%, more preferably from 88% to 100%, more preferably from 89% to 100%, even more preferably from 90% to 100%, even more preferably from 91% to 100%, even more preferably from 92% to 100%, even more preferably from 93% to 100%, even more preferably from 94% to 100%, even more preferably from 95% to 100%, even more preferably from 96% to 100%, even more preferably from 97% to 100%, even more preferably from 98% to 100%, even more preferably from 99% to 100%, and most preferably 100%;
and wherein the trehalose phosphorylase is defined as in any one of embodiments 1 to 120 or of any other of the embodiments of the first aspect, preferably as in any one of embodiments 27, 28, 29, 31, 35, 36, 41, 42, 43, 44, 45, 46, 57, 69, 70, 75, 76, 77, 78, 79, 80, 82, 84, 88, 90, 93, 99, 100 and 102 of the first aspect, more preferably any one of embodiments 27, 28, 29, 31, 35, 36, 57, 69, 70, 75, 76, 77, 78, 79, 80, 82, 84, 88, 90, 93, 99, 100 and 102 of the first aspect.

In an eighth embodiment of the second aspect which is also an embodiment of the first, second, third, fourth, fifth and seventh embodiment of the second aspect, the polypeptide, preferably the trehalose phosphorylase, has thermal stability characterized by a Tm30-value of at least 52° C. and/or a Tm50-value of at least 52° C.; and wherein the trehalose phosphorylase is defined as in any one of embodiments 1 to 120 or of any other of the embodiments of the first aspect, preferably as in any one of embodiments 27, 28, 29, 31, 35, 36, 41, 42, 43, 44, 45, 46, 57, 69, 70, 75, 76, 77, 78, 79, 80, 82, 84, 88, 90, 93, 99, 100 and 102 of the first aspect, more preferably any one of embodiments 27, 28, 29, 31, 35, 36, 57, 69, 70, 75, 76, 77, 78, 79, 80, 82, 84, 88, 90, 93, 99, 100 and 102 of the first aspect.

In a ninth embodiment of the second aspect which is also an embodiment of the first, second, third, fourth, fifth, seventh and eighth embodiment of the second aspect, the polypeptide, preferably the trehalose phosphorylase, has a half-life at 45° C. of from 1 day to 9 days or more, more preferably of from 2 days to 9 days or more, more preferably of from 4 days to 9 days or more, more preferably of from 5.5 days to 9 days or more, more preferably of from 7 days to 9 days or more, even more preferably of 9 days or more, and most preferably of 9 days; and wherein the polypeptide, preferably the trehalose phosphorylase, is defined as in any one of embodiments 1 to 120 or of any other of the embodiments of the first aspect, preferably as in any one of embodiments 27, 28, 29, 31, 35, 36, 41, 42, 43, 44, 45, 46, 57, 69, 70, 75, 76, 77, 78, 79, 80, 82, 84, 88, 90, 93, 99, 100 and 102 of the first aspect, more preferably any one of embodiments 27, 28, 29, 31, 35, 36, 57, 69, 70, 75, 76, 77, 78, 79, 80, 82, 84, 88, 90, 93, 99, 100 and 102 of the first aspect.

In a tenth embodiment of the second aspect which is also an embodiment of the first, second, third, fourth, fifth, seventh, eighth and ninth embodiment of the second aspect, the polypeptide, preferably the trehalose phosphorylase has relative activity expressed as 100/500-ratio of between 0.65 and 1.0, preferably of between 0.7 and 1.0, preferably of between 0.75 and 1.0, preferably of between 0.8 and 1.0, preferably of between 0.85 and 1.0, preferably of between 0.9 and 1.0, preferably of between 0.95 and 1.0, and more preferably of between 0.7 and 1.0; and wherein the trehalose phosphorylase is defined as in any one of embodiments 1 to 120 or of any other of the embodiments of the first aspect, preferably as in any one of embodiments 27, 28, 29, 31, 35, 36, 41, 42, 43, 44, 45, 46, 57, 69, 70, 75, 76, 77, 78, 79, 80, 82, 84, 88, 90, 93, 99, 100 and 102 of the first aspect, more preferably any one of embodiments 27, 28, 29, 31, 35, 36, 57, 69, 70, 75, 76, 77, 78, 79, 80, 82, 84, 88, 90, 93, 99, 100 and 102 of the first aspect.

In an eleventh embodiment of the second aspect which is also an embodiment of the first, second, third, fourth and fifth embodiment of the second aspect, the polypeptide, preferably the trehalose phosphorylase, has thermal stability after incubation at 52° C. for 15 minutes defined by a residual activity from 55% from to 100%, preferably from 60% to 100%, preferably from 70% to 100%, preferably from 75% to 100%, preferably from 76% to 100%, preferably from 77% to 100%, preferably from 78% to 100%, preferably from 79% to 100%, more preferably from 80% to 100%, more preferably from 81% to 100%, more preferably from 82% to 100%, more preferably from 83% to 100%, more preferably from 84% to 100%, more preferably from 85% to 100%, more preferably from 86% to 100%, more preferably from 87% to 100%, more preferably from 88% to 100%, more preferably from 89% to 100%, even more preferably from 90% to 100%, even more preferably from 91% to 100%, even more preferably from 92% to 100%, even more preferably from 93% to 100%, even more preferably from 94% to 100%, even more preferably from 95% to 100%, even more preferably from 96% to 100%, even more preferably from 97% to 100%, even more preferably from 98% to 100%, even more preferably from 99% to 100%, and most preferably of 100%; and wherein the trehalose phosphorylase is defined as in any one of embodiments 1 to 120 or of any other of the embodiments of the first aspect, preferably as in any one of embodiments 28, 29, 32, 37, 38, 39, 40, 41, 42, 43, 44, 45, 46, 59, 60, 61, 62, 71, 72, 73, 74, 75, 76, 77, 78, 79, 80, 82, 84, 88, 91, 94, 99, 100 and 102 of the first aspect, more preferably any one of embodiments 28, 29, 32, 37, 38, 39, 40, 59, 60, 61, 62, 71, 72, 73, 74, 75, 76, 77, 78, 79, 80, 82, 84, 88, 91, 94, 99, 100 and 102 of the first aspect.

In a twelfth embodiment of the second aspect which is also an embodiment of the first, second, third, fourth, fifth and eleventh embodiment of the second aspect, the polypeptide, preferably the trehalose phosphorylase has thermal stability characterized by a Tm30-value of at least 52° C. and/or a Tm50-value of at least 52° C., and which is preferably characterized by a Tm30-value of a at least 52° C. and a Tm50-value of at least 52° C.; and wherein the trehalose phosphorylase is defined as in any one of embodiments 1 to 120 or of any other of the embodiments of the first aspect, preferably as in any one of embodiments 28, 29, 32, 37, 38, 39, 40, 41, 42, 43, 44, 45, 46, 59, 60, 61, 62, 71, 72, 73, 74, 75, 76, 77, 78, 79, 80, 82, 84, 88, 91, 94, 99, 100 and 102 of the first aspect, more preferably any one of embodiments 28, 29, 32, 37, 38, 39, 40, 59, 60, 61, 62, 71, 72, 73, 74, 75, 76, 77, 78, 79, 80, 82, 84, 88, 91, 94, 99, 100 and 102 of the first aspect.

In a 13$^{th}$ embodiment of the second aspect which is also an embodiment of the first, second, third, fourth, fifth, eleventh and twelfth embodiment of the second aspect, the polypeptide, preferably the trehalose phosphorylase has thermal stability characterized by i) a Tm30-between 52° C. and 90° C., preferably between 52° C. and 80° C., preferably between a 52.5° C. and 80° C., preferably between 53° C. and 80° C., preferably between 53.5° C. and 80° C., more preferably between 54° C. and 80° C., preferably between 54.5° C. and 80° C., even more preferably between 55° C. and 80° C., preferably between 55.5° C. and 80° C., preferably between 56° C. and 80° C., preferably between 56.5° C. and 80° C., preferably between 57° C. and 80° C., preferably between 57.5° C. and 80° C., preferably between 58° C. and 80° C., preferably between 58.5° C. and 80° C., even more preferably between 52° C. and 70° C., even more preferably between 52.5° C. and 70° C., even more preferably between 53° C. and 70° C., even more preferably between 53.5° C. and 70° C., more even more preferably between 54° C. and 70° C., even more preferably between 54.5° C. and 70° C., even more even more preferably between 55° C. and 70° C., even more preferably between 55.5° C. and 70° C., even more preferably between 56° C. and 70° C., even more preferably between 56.5° C. and 70° C., even more preferably between 57° C. and 70° C., even more preferably between 57.5° C. and 70° C., even more preferably between 58° C. and 70° C., even more preferably between 58.5° C. and 70° C., even more preferably between 52° C. and 65° C., even more preferably between 52.5° C. and 65° C., even more preferably between 53° C. and 65° C., even more preferably between 53.5° C. and 65° C., more even more preferably between 54° C. and 65° C., even more preferably between 54.5° C. and 65° C., even more even more preferably between 55° C. and 65° C., even more preferably between 55.5° C. and 65° C., even more preferably between 56° C. and 65° C., even more preferably between 56.5° C. and 65° C., even more preferably between 57° C. and 65° C., even more preferably between 57.5° C. and 65° C., even more preferably between 58° C. and 65° C., even more preferably between 58.5° C. and 65° C., even more preferably between 52° C. and 60° C., even more preferably between 52.5° C. and 60° C., even more preferably between 53° C. and 60° C., even more preferably between 53.5° C. and 60° C., more even more preferably between from 54° C. and 60° C., even more preferably between from 54.5° C. and 60° C., even more even more preferably between 55° C. and 60° C., even more preferably between 55.5° C. and 60° C., even more preferably between 56° C. and 60° C., even more preferably between 56.5° C. and 60° C., even more preferably between 57° C. and 60° C., even more preferably between 57.5° C. and 60° C., even more preferably between 58° C. and 60° C., even more preferably between 58.5° C. and 60° C., and most preferably between 53.5° C. and 58.5° C. and/or ii) a Tm50-value between 52° C. and 90° C., preferably between 52° C. and 80° C., preferably between 52.5° C. and 80° C., preferably between 53° C. and 80° C., preferably between 53.5° C. and 80° C., more preferably between 54° C. and 80° C., preferably between 54.5° C. and 80° C., even more preferably between 55° C. and 80° C., preferably between 55.5° C. and 80° C., preferably between 56° C. and 80° C., preferably between 56.5° C. and 80° C., preferably between 57° C. and 80° C., preferably between 57.5° C. and 80° C., even more preferably between 52° C. and 70° C., even more preferably between 52.5° C. and 70° C., even more preferably between 53° C. and 70° C., even more preferably between 53.5° C. and 70° C., more even more preferably between 54° C. and 70° C., even more preferably between 54.5° C. and 70° C., even more even more preferably between 55° C. and 70° C., even more preferably between 55.5° C. and 70° C., even more preferably between 56° C. and 70° C., even more preferably between 56.5° C. and 70° C., even more preferably between 57° C. and 70° C., even more preferably between 57.5° C. and 70° C., even more preferably between 52° C. and 65° C., even more preferably between 52.5° C. and 65° C., even more preferably between 53° C. and 65° C., even more preferably between 53.5° C. and 65° C., more even more preferably between 54° C. and 65° C., even more preferably between 54.5° C. and 65° C., even more even more preferably between 55° C. and 65° C., even more preferably between 55.5° C. and 65° C., even more preferably between 56° C. and 65° C., even more preferably between 56.5° C. and 65° C., even more preferably between 57° C. and 65° C., even more preferably between 57.5° C. and 65° C., even more preferably between 52° C. and 60° C., even more preferably between 52.5° C. and 60° C., even more preferably between 53° C. and 60° C., even more preferably between 53.5° C. and 60° C., more even more preferably between 54° C. and 60° C., even more preferably between 54.5° C. and 60° C., even more even more preferably between 55° C. and 60° C., even more preferably between 55.5° C. and 60° C., even more preferably between 56° C. and 60° C., even more preferably between 56.5° C. and 60° C., even more preferably between 57° C. and 60° C., even more preferably between 57.5° C. and 60° C., and most preferably between 52° C. and 57.5° C.; and wherein the trehalose phosphorylase is defined as in any one of embodiments 1 to 120 or of any other of the embodiments of the first aspect, preferably as in any one of embodiments 28, 29, 32, 37, 38, 39, 40, 41, 42, 43, 44, 45, 46, 59, 60, 61, 62, 71, 72, 73, 74, 75, 76, 77, 78, 79, 80, 82, 84, 88, 91, 94, 99, 100 and 102 of the first aspect.

In a 14$^{th}$ embodiment of the second aspect which is also an embodiment of the first, second, third, fourth, fifth, eleventh, twelfth and 13$^{th}$ embodiment of the second aspect, the polypeptide, preferably the trehalose phosphorylase, has a half-life at 45° C. of from 4 days to 9 days or more, preferably of from 5.5 days to 9 days or more, more preferably of from 7 days to 9 days or more, even more preferably of 9 days or more, most preferably of 9 days; and wherein the polypeptide, preferably the trehalose phosphorylase is defined as in any one of embodiments 1 to 120 or of any other of the embodiments of the first aspect, preferably as in any one of embodiments 28, 29, 32, 37, 38, 39, 40, 41, 42, 43, 44, 45, 46, 59, 60, 61, 62, 71, 72, 73, 74, 75, 76, 77, 78, 79, 80, 82, 84, 88, 91, 94, 99, 100 and 102 of the first aspect, more preferably any one of embodiments 28, 29, 32, 37, 38, 39, 40, 59, 60, 61, 62, 71, 72, 73, 74, 75, 76, 77, 78, 79, 80, 82, 84, 88, 91, 94, 99, 100 and 102 of the first embodiment.

In a 15$^{th}$ embodiment of the second aspect which is also an embodiment of the first, second, third, fourth, fifth, eleventh, twelfth, 13$^{th}$ and 14$^{th}$ embodiment of the second aspect, the polypeptide, preferably the trehalose phosphorylase, has a relative activity expressed as 100/500-ratio of between 0.65 and 1.0, preferably of between 0.7 and 1.0, preferably of between 0.75 and 1.0, preferably of between 0.8 and 1.0, preferably of between 0.85 and 1.0, preferably of between 0.9 and 1.0, preferably of between 0.95 and 1.0, and more preferably of between 0.8 and 1.0; and wherein the trehalose phosphorylase is defined as in any one of embodiments 1 to 120 or of any other of the embodiments of the first aspect, preferably as in any one of embodiments 28, 29, 32, 37, 38, 39, 40, 41, 42, 43, 44, 45, 46, 59, 60, 61, 62, 71, 72, 73, 74, 75, 76, 77, 78, 79, 80, 82, 84, 88, 91, 94, 99, 100 and 102 of the first aspect.

In a 16$^{th}$ embodiment of the second aspect which is also an embodiment of the first, second, third, fourth, fifth and sixth embodiment of the second aspect, the polypeptide, preferably the trehalose phosphorylase has, compared to a trehalose phosphorylase of SEQ ID NO:1, an increase in thermal stability, whereby the increase in thermal stability is
i) an increase of the Tm30-value of at least 2° C. up to 40.5° C., preferably 2° C. up to 30.5° C., preferably of at least 2.5° C. up to 30.5° C., preferably of at least 3° C. up to 30.5° C., preferably of at least 3.5° C. up to 30.5° C., preferably of at least 4° C. up to 30.5° C., preferably of at least 4.5° C. up to 30.5° C., preferably of at least 5° C. up to 30.5° C., preferably of at least 5.5° C. up to 30.5° C., preferably of at least 6° C. up to 30.5° C., preferably of at least 6.5° C. up to 30.5° C., preferably of at least 7° C. up to 30.5° C., preferably of at least 7.5° C. up to 30.5° C., preferably of at least 8° C. up to 30.5° C., preferably of at least 8.5° C. up to 30.5° C., preferably of at least 9° C. up to 30.5° C., more preferably 2° C. up to 20.5° C., more preferably of at least 2.5° C. up to 20.5° C., more preferably of at least 3° C. up to 20.5° C., more preferably of at least 3.5° C. up to 20.5° C., more preferably of at least 4° C. up to 20.5° C., more preferably of at least 4.5° C. up to 20.5° C., more preferably of at least 5° C. up to 20.5° C., more preferably of at least 5.5° C. up to 20.5° C., more preferably of at least 6° C. up to 20.5° C., more preferably of at least 6.5° C. up to 20.5° C., more preferably of at least 7° C. up to 20.5° C., more preferably of at least 7.5° C. up to 20.5° C., more preferably of at least 8° C. up to 20.5° C., more preferably of at least 8.5° C. up to 20.5° C., more preferably of at least 9° C. up to 20.5° C., even more preferably 2° C. up to 15.5° C., even more preferably of at least 2.5° C. up to 15.5° C., even more preferably of at least 3° C. up to 15.5° C., even more preferably of at least 3.5° C. up to 15.5° C., even more preferably of at least 4° C. up to 15.5° C., even more preferably of at least 4.5° C. up to 15.5° C., even more preferably of at least 5° C. up to 15.5° C., even more preferably of at least 5.5° C. up to 15.5° C., even more preferably of at least 6° C. up to 15.5° C., even more preferably of at least 6.5° C. up to 15.5° C., even more preferably of at least 7C up to 15.5° C., even more preferably of at least 7.5° C. up to 15.5° C., even more preferably of at least 8° C. up to 15.5° C., even more preferably of at least 8.5° C. up to 15.5° C., even more preferably of at least 9° C. up to 15.5° C., even more preferably 2° C. up to 10.5° C., even more preferably of at least 2.5° C. up to 10.5° C., even more preferably of at least 3° C. up to 10.5° C., even more preferably of at least 3.5° C. up to 10.5° C., even more preferably of at least 4° C. up to 10.5° C., even more preferably of at least 4.5° C. up to 10.5° C., even more preferably of at least 5C up to 10.5° C., even more preferably of at least 5.5° C. up to 10.5° C., even more preferably of at least 6° C. up to 10.5° C., even more preferably of at least 6.5° C. up to 10.5° C., even more preferably of at least 7° C. up to 10.5° C., even more preferably of at least 7.5° C. up to 10.5° C., even more preferably of at least 8° C. up to 10.5° C., even more preferably of at least 8.5° C.

up to 10.5° C., even more preferably of at least 9° C. up to 10.5° C., and most preferably by at least 4° C. up to 9° C.;

ii) an increase of the Tm50-value of at least 2° C. up to 42.5° C., preferably 2° C. up to 32.5° C., preferably of at least 2.5° C. up to 32.5° C., preferably of at least 3° C. up to 32.5° C., preferably of at least 3.5° C. up to 32.5° C., preferably of at least 4° C. up to 32.5° C., preferably of at least 4.5° C. up to 32.5° C., preferably of at least 5° C. up to 32.5° C., preferably of at least 5.5° C. up to 32.5° C., preferably of at least 6° C. up to 32.5° C., preferably of at least 6.5° C. up to 32.5° C., preferably of at least 7° C. up to 32.5° C., preferably of at least 7.5° C. up to 32.5° C., preferably of at least 8° C. up to 32.5° C., preferably of at least 8.5° C. up to 32.5° C., preferably of at least 9° C. up to 32.5° C., preferably of at least 9.5° C. up to 32.5° C., preferably of at least 10° C. up to 32.5° C., more preferably 2° C. up to 22.5° C., more preferably of at least 2.5° C. up to 22.5° C., more preferably of at least 3° C. up to 22.5° C., more preferably of at least 3.5° C. up to 22.5° C., more preferably of at least 4° C. up to 22.5° C., more preferably of at least 4.5° C. up to 22.5° C., more preferably of at least 5° C. up to 22.5° C., more preferably of at least 5.5° C. up to 22.5° C., more preferably of at least 6° C. up to 22.5° C., more preferably of at least 6.5° C. up to 22.5° C., more preferably of at least 7° C. up to 22.5° C., more preferably of at least 7.5° C. up to 22.5° C., more preferably of at least 8° C. up to 22.5° C., more preferably of at least 8.5° C. up to 22.5° C., more preferably of at least 9° C. up to 22.5° C., more preferably of at least 9.5° C. up to 22.5° C., more preferably of at least 10° C. up to 22.5° C., even more preferably 2° C. up to 17.5° C., even more preferably of at least 2.5° C. up to 17.5° C., even more preferably of at least 3° C. up to 17.5° C., even more preferably of at least 3.5° C. up to 17.5° C., even more preferably of at least 4° C. up to 17.5° C., even more preferably of at least 4.5° C. up to 17.5° C., even more preferably of at least 5° C. up to 17.5° C., even more preferably of at least 5.5° C. up to 17.5° C., even more preferably of at least 6° C. up to 17.5° C., even more preferably of at least 6.5° C. up to 17.5° C., even more preferably of at least 7° C. up to 17.5° C., even more preferably of at least 7.5° C. up to 17.5° C., even more preferably of at least 8° C. up to 17.5° C., even more preferably of at least 8.5° C. up to 17.5° C., even more preferably of at least 9C up to 17.5° C., even more preferably of at least 9.5° C. up to 17.5° C., even more preferably of at least 10° C. up to 17.5° C., even more preferably 2° C. up to 12.5° C., even more preferably of at least 2.5° C. up to 12.5° C., even more preferably of at least 3° C. up to 12.5° C., even more preferably of at least 3.5° C. up to 12.5° C., even more preferably of at least 4° C. up to 12.5° C., even more preferably of at least 4.5° C. up to 12.5° C., even more preferably of at least 5C up to 12.5° C., even more preferably of at least 5.5° C. up to 12.5° C., even more preferably of at least 6° C. up to 12.5° C., even more preferably of at least 6.5° C. up to 12.5° C., even more preferably of at least 7° C. up to 12.5° C., even more preferably of at least 7.5° C. up to 12.5° C., even more preferably of at least 8° C. up to 12.5° C., even more preferably of at least 8.5° C. up to 12.5° C., even more preferably of at least 9° C. up to 12.5° C., even more preferably of at least 9.5° C. up to 12.5° C., even more preferably of at least 10° C. up to 12.5° C., and most preferably by at least 4° C. up to 9° C.;

iii) an improved process stability, characterized by an increased half-life at 45° C. of i) at least 3-fold up to 216-fold or more, preferably of at least 24-fold up to 216-fold or more, preferably of at least 39-fold up to 216-fold or more, preferably of at least 48-fold up to 216-fold or more, preferably of at least 96-fold up to 216-fold or more, preferably of at least 132-fold up to 216-fold or more, even more preferably of at least 216-fold or more, and most preferably of 216-fold;

ii) at least 24-fold up to 216-fold or more, preferably of at least 39-fold up to 216-fold or more, preferably of at least 48-fold up to 216-fold or more, preferably of at least 96-fold up to 216-fold or more, preferably of at least 132-fold up to 216-fold or more, even more preferably of at least 216-fold or more, and most preferably of 216-fold;

iii) at least 96-fold up to 216-fold or more, preferably of at least 132-fold up to 216-fold or more, even more preferably of at least 216-fold or more, and most preferably of 216-fold.

In a 17$^{th}$ embodiment of the second aspect which is also an embodiment of the 16$^{th}$ embodiment of the second aspect, the polypeptide, preferably the trehalose phosphorylase, is a polypeptide, preferably a trehalose phosphorylase, as defined as in any one of embodiments 1 to 120 or of any other of the embodiments of the first aspect, preferably in any one of embodiments 27, 28, 29, 31, 35, 36, 41, 42, 43, 44, 45, 46, 57, 69, 70, 75, 76, 77, 78, 79, 80, 82, 84, 88, 90, 93, 99, 100 and 102 of the first aspect.

In an 18$^{th}$ embodiment of the second aspect which is also an embodiment of the 16$^{th}$ embodiment of the second aspect, the polypeptide, preferably the trehalose phosphorylase, is a polypeptide, preferably a trehalose phosphorylase, as defined as in any one of embodiments 1 to 120 or of any other of the embodiments of the first aspect, preferably in any one of embodiments 28, 29, 32, 37, 38, 39, 40, 41, 42, 43, 44, 45, 46, 59, 60, 61, 62, 71, 72, 73, 74, 75, 76, 77, 78, 79, 80, 82, 84, 88, 91, 94, 99, 100 and 102 of the first aspect.

In an 19$^{th}$ embodiment of the second aspect which is also an embodiment of the first, second, third, fourth, fifth, sixth, seventh, eighth, ninth, tenth, eleventh, twelfth, 13$^{th}$, 14$^{th}$, 15$^{th}$, 16$^{th}$, 17$^{th}$ and 18$^{th}$ of the second aspect, the polypeptide, preferably the trehalose phosphorylase, is a polypeptide, preferably a trehalose phosphorylase, as defined as in any one of embodiments 1 to 120 or of any other of the embodiments of the first aspect, preferably as defined in any one of embodiments 28, 29, 32, 37, 38, 39, 40, 41, 42, 43, 44, 45, 46, 59, 60, 61, 62, 71, 72, 73, 74, 75, 76, 77, 78, 79, 80, 82, 84, 88, 91, 94, 99, 100 and 102 of the first aspect wherein the polypeptide, preferably the trehalose phosphorylase, is capable of catalyzing reaction of a glucosyl monosaccharide and alpha-D-glucose-1 phosphate.

In an 20$^{th}$ embodiment of the second aspect which is also an embodiment of the 19$^{th}$ embodiment of the second aspect, the polypeptide, preferably the trehalose phosphorylase, is capable of catalyzing conversion of glucose and alpha-D-glucose-1 phosphate to trehalose and inorganic phosphate and/or conversion of trehalose and inorganic phosphate to glucose and alpha-D-glucose-1 phosphate.

In a 21st embodiment of the second aspect which is also an embodiment of the 19th and 20th embodiment of the second aspect, the conversion is a reversible conversion.

In a 22nd embodiment of the second aspect which is also an embodiments of the first, second, third, fourth, fifth, sixth, seventh, eighth, ninth, tenth, eleventh, twelfth, 13th, 14th, 15th, 16th, 17th 18th, 19th, 20th and 21st embodiment of the second aspect, the polypeptide, preferably the trehalose phosphorylase, is a trehalose phosphorylase according to EC number EC 2.4.1.231.

More specifically, these and other problems are solved in a third aspect, which is also the first embodiment of the third aspect, by a thermally stable trehalose phosphorylase variant wherein the variant retains at least 30% of its initial activity after incubation for 15 minutes at 52° C. in a buffer containing 1 M sucrose, and the initial activity is determined after incubation for 15 minutes at room temperature.

In an 2nd embodiment of the third aspect which is also an embodiment of the first embodiment of the third aspect, the variant retains at least 50% of its initial activity after incubation for 15 minutes at 52° C. in a buffer containing 1 M sucrose, and the initial activity is determined after incubation for 15 minutes at room temperature.

More specifically, these and other problems are solved in a fourth aspect, which is also the first embodiment of the fourth aspect, by a thermally stable variant of trehalose phosphorylase which is derived from an organism belonging to the phylum of Basidomycota, preferably from an organism belonging to the class of Agaricomycetes, and more preferably from an organism belonging to a genus of the group consisting of the genera *Schizophyllum, Pleurotus, Grifola, Agaricus, Trametes, Coriolus, Trametes, Trichaptum*, and *Lenzites*, and most preferably from the organisms *Schizophyllum commune*, or from *Grifola frondosa*, wherein the variant has a residual activity of at least 30% after incubation at 52° C. for 15 minutes, and the initial activity is determined after incubation for 15 minutes at room temperature.

In a preferred embodiment of the first embodiment of the fourth aspect of the invention, the thermally stable variant of trehalose phosphorylase has a residual activity of at least 30% after incubation at 52° C. for 15 minutes, wherein the initial activity is determined after incubation for 15 minutes at room temperature and wherein the trehalose phosphorylase is a variant from *Schizophyllum commune* trehalose phosphorylase.

In another preferred embodiment of the first embodiment of the fourth aspect of the invention, the thermally stable variant of trehalose phosphorylase has a residual activity of at least 30% after incubation at 52° C. for 15 minutes, and wherein the initial activity is determined after incubation for 15 minutes at room temperature and wherein the trehalose phosphorylase is a variant from *Grifola frondosa* trehalose phosphorylase.

More specifically, these and other problems are solved in a 14th aspect, which is also the first embodiment of the 14th aspect, by a polypeptide, preferably a trehalose phosphorylase, comprising an amino acid sequence, wherein the amino acid sequence of the trehalose phosphorylase is at least 85% identical to and/or at least 86% homologous to an amino acid sequence of SEQ ID NO: 81 or SEQ ID NO: 160, preferably SEQ ID NO: 160, wherein the amino acid sequence of the trehalose phosphorylase comprises an amino acid substitution at one or more amino acid positions, wherein the one or more amino acid positions is/are selected from the group consisting of amino acid positions 108, 112, 221, 300, 319, 345, 379, 483, 544, 550, 558, 584, 643, and 707 of SEQ ID NO:81 or SEQ ID NO: 160, preferably of SEQ ID NO: 160, and which is/are preferably selected from the group consisting of amino acid positions 108, 112, 221, 300, 319, 379, 483, 544, 550, and 558 of SEQ ID NO:81 or SEQ ID NO: 160, preferably of SEQ ID NO: 160, and which is/are more preferably selected from the group consisting of amino acid positions 108, 221, 319, 379, 483, 550, and 558 of SEQ ID NO: 81 or SEQ ID NO: 160, preferably SEQ ID NO: 160.

In a second embodiment of the 14th aspect which is also an embodiment of the first embodiment of the 14th aspect, the one or more amino acid positions is/are selected from the group consisting of amino acid positions of L108, V112, N221, A300, T319, F345, P379, V483, V544, S550, Q558, N584, A643, and L707 of SEQ ID NO: 160, which is preferably selected from the group consisting of amino acid positions L108, V112, N221, A300, T319, P379, V483, V544, S550, and Q558 of SEQ ID NO: 160, and which is more preferably selected from the group consisting of amino acid positions L108, V221, T319, P379, V483, S550, and Q558 of SEQ ID NO: 160.

In a third embodiment of the 14th aspect which is also an embodiment of the first embodiment of the 14th aspect, the one or more amino acid positions is/are selected from the group consisting of amino acid positions of L108, V112, N221, A300, T319, F345, P379, 1483, V544, S550, Q558, N584, A643, and L707 of SEQ ID NO:81, which is preferably selected from the group consisting of amino acid positions L108, V112, N221, A300, T319, P379, 1483, V544, S550, and Q558 of SEQ ID NO:81, and which is more preferably selected from the group consisting of amino acid positions L108, V221, T319, P379, 1483, S550, and 558 of SEQ ID NO:81.

In a fourth embodiment of the 14th aspect which is also an embodiment of any other embodiment of the 14th aspect, the amino acid sequence of the trehalose phosphorylase comprises an amino acid substitution at one or more amino acid positions, wherein the one or more amino acid positions is/are selected from the group consisting of amino acid positions 108, 112, 221, 300, 319, 345, 379, 483, 544, 550, 558, 584, 643, and 707 of SEQ ID NO: 81 or SEQ ID NO: 160, preferably of SEQ ID NO: 160. As surprisingly found in the context of the present invention, the mutation of one or more of these positions increased the thermal stability of the enzyme leading to a residual activity after 15 min incubation at 52.5° C. of at least 12% in comparison to 9% of trehalose phosphorylase encoded by the wild type amino acid sequence of SEQ ID NO: 160.

In a fifth preferred embodiment of the 14th aspect which is also an embodiment of any other embodiment of the 14th aspect, the amino acid sequence of the trehalose phosphorylase comprises an amino acid substitution at one or more amino acid positions, wherein the one or more amino acid positions is/are selected from the group consisting of amino acid positions 108, 112, 221, 300, 319, 379, 483, 544, 550, and 558 of SEQ ID NO: 81 or SEQ ID NO: 160, preferably of SEQ ID NO: 160. As surprisingly found in the context of the present invention, the mutation of one or more of these positions increased the thermal stability of the enzyme leading to a residual activity after 15 min incubation at 52.5° C. of at least 30% in comparison to 9% of trehalose phosphorylase encoded by the wild type amino acid sequence of SEQ ID NO: 160.

In a sixth embodiment of the 14th aspect which is also an embodiment of the first embodiment of the 14th aspect, the amino acid sequence of the trehalose phosphorylase comprises an amino acid substitution at one or more amino acid positions, wherein the one or more amino acid positions is/are more preferably selected from the group consisting of amino acid positions 108, 221, 319, 379, 483, 550, and 558 of SEQ ID NO: 81 or SEQ ID NO: 160, preferably SEQ ID NO: 160. As surprisingly found in the context of the present invention, the mutation of these positions increased the thermal stability of the enzyme leading to a residual activity after 15 min incubation at 52.5° C. of at least 50% in comparison to 9% of trehalose phosphorylase encoded by the wild type amino acid sequence of SEQ ID NO: 160.

In a seventh embodiment of the 14$^{th}$ aspect, which is also an embodiment of any of the previous embodiments of the 14$^{th}$ aspect, the amino acid sequence of the trehalose phosphorylase comprises an amino acid sequence according to any one of SEQ ID NO: 161, 162, 163, 164, 165, 166, 167, 168, 169, 170, 171, 172, 173, 174, 175, 176, 177, 178, 179, 180, 181, 182, 183, 184, 185, 186, 187, 188, and 189, preferably according to any one of SEQ ID NO: 163, 165, 166, 168, 171, 173, 176, 177, 178, 179, 180, 184, 185, 186, 187, 188, and 189, more preferably according to any one of SEQ ID NO: 176, 178, 180, 185, and 188.

In eighth embodiment of the 14$^{th}$ aspect, which is also an embodiment of any of the previous embodiments of the 14$^{th}$ aspect, the amino acid sequence of the trehalose phosphorylase consists of an amino acid sequence according to any one of SEQ ID NO: 161, 162, 163, 164, 165, 166, 167, 168, 169, 170, 171, 172, 173, 174, 175, 176, 177, 178, 179, 180, 181, 182, 183, 184, 185, 186, 187, 188, and 189, preferably according to any one of SEQ ID NO: 163, 165, 166, 168, 171, 173, 176, 177, 178, 179, 180, 184, 185, 186, 187, 188, and 189, more preferably according to any one of SEQ ID NO: 176, 178, 180, 185, and 188.

In a ninth embodiment of the 14$^{th}$ aspect which is also an embodiment of any of the previous embodiments of the 14$^{th}$ aspect, the one or more amino acid positions is two or more amino acid positions.

In a tenth embodiment of the 14$^{th}$ aspect which is also an embodiment of any of the previous embodiments of the 14$^{th}$ aspect, the one or more amino acid positions is three or more amino acid positions.

In a eleventh embodiment of the 14$^{th}$ aspect which is also an embodiment of any of the previous embodiments of the 14$^{th}$ aspect, the one or more amino acid positions is four or more amino acid positions.

In a twelfth embodiment of the 14$^{th}$ aspect which is also an embodiment of any of the previous embodiments of the 14$^{th}$ aspect, the two or more amino acid positions comprises a pair of two amino acid positions, wherein the pair of two amino acid positions is selected from the group consisting of 108 and 112, 108 and 221, 108 and 300, 108 and 319, 108 and 345, 108 and 379, 108 and 483, 108 and 544, 108 and 550, 108 and 558, 108 and 584, 108 and 643, 108 and 707, 112 and 221, 112 and 300, 112 and 319, 112 and 345, 112 and 379, 112 and 483, 112 and 544, 112 and 550, 112 and 558, 112 and 584, 112 and 643, 112 and 707, 221 and 300, 221 and 319, 221 and 345, 221 and 379, 221 and 483, 221 and 544, 221 and 550, 221 and 558, 221 and 584, 221 and 643, 221 and 707, 300 and 319, 300 and 345, 300 and 379, 300 and 483, 300 and 544, 300 and 550, 300 and 558, 300 and 584, 300 and 643, 300 and 707, 319 and 345, 319 and 379, 319 and 483, 319 and 544, 319 and 550, 319 and 558, 319 and 584, 319 and 643, 319 and 707, 345 and 379, 345 and 483, 345 and 544, 345 and 550, 345 and 558, 345 and 584, 345 and 643, 345 and 707, 379 and 483, 379 and 544, 379 and 550, 379 and 558, 379 and 584, 379 and 643, 379 and 707, 483 and 544, 483 and 550, 483 and 558, 483 and 584, 483 and 643, 483 and 707, 544 and 550, 544 and 558, 544 and 584, 544 and 643, 544 and 707, 550 and 558, 550 and 584, 550 and 643, 550 and 707, 558 and 584, 558 and 643, 558 and 707, 584 and 643, 584 and 707, and 643 and 707 of SEQ ID NO: 160 or SEQ ID NO: 81, preferably from the group consisting of L108 and V112, L108 and N221, L108 and A300, L108 and T319, L108 and F345, L108 and P379, L108 and V483 of SEQ ID NO: 160 or I483 of SEQ ID NO: 81, respectively, L108 and V544, L108 and S550, L108 and Q558, L108 and N584, L108 and A643, L108 and L707, V112 and N221, V112 and A300, V112 and T319, V112 and F345, V112 and P379, V112 and V483 of SEQ ID NO: 160 or I483 of SEQ ID NO: 81, respectively, V112 and V544, V112 and S550, V112 and Q558, V112 and N584, V112 and A643, V112 and L707, N221 and A300, N221 and T319, N221 and F345, N221 and P379, N221 and V483 of SEQ ID NO: 160 or I483 of SEQ ID NO: 81, respectively, N221 and V544, N221 and S550, N221 and Q558, N221 and N584, N221 and A643, N221 and L707, A300 and T319, A300 and F345, A300 and P379, A300 and V483 of SEQ ID NO: 160 or I483 of SEQ ID NO: 81, respectively, A300 and V544, A300 and S550, A300 and Q558, A300 and N584, A300 and A643, A300 and L707, T319 and F345, T319 and P379, T319 and V483 of SEQ ID NO: 160 or I483 of SEQ ID NO: 81, respectively, T319 and V544, T319 and S550, T319 and Q558, T319 and N584, T319 and A643, T319 and L707, F345 and P379, F345 and V483 of SEQ ID NO: 160 or I483 of SEQ ID NO: 81, respectively, F345 and V544, F345 and S550, F345 and Q558, F345 and N584, F345 and A643, F345 and L707, P379 and V483 of SEQ ID NO: 160 or I483 of SEQ ID NO: 81, respectively, P379 and V544, P379 and S550, P379 and Q558, P379 and N584, P379 and A643, P379 and L707, V483 of SEQ ID NO: 160 or I483 of SEQ ID NO: 81, respectively, and V544, V483 of SEQ ID NO: 160 or I483 of SEQ ID NO: 81, respectively, and S550, V483 of SEQ ID NO: 160 or I483 of SEQ ID NO: 81, respectively, and Q558, V483 of SEQ ID NO: 160 or I483 of SEQ ID NO: 81, respectively, and N584, V483 of SEQ ID NO: 160 or I483 of SEQ ID NO: 81, respectively, and A643, V483 of SEQ ID NO: 160 or I483 of SEQ ID NO: 81, respectively, and L707, V544 and S550, V544 and Q558, V544 and N584, V544 and A643, V544 and L707, S550 and Q558, S550 and N584, S550 and A643, S550 and L707, Q558 and N584, Q558 and A643, Q558 and L707, N584 and A643, N584 and L707, and A643 and L707.

In an 13$^{th}$ embodiment of the 14$^{th}$ aspect which is also an embodiment of any of the previous embodiments of the 14$^{th}$ aspect, the pair of two amino acid positions is selected from the group consisting of L108 and V112, L108 and N221, L108 and A300, L108 and T319, L108 and P379, L108 and V483 of SEQ ID NO: 160 or I483 of SEQ ID NO: 81, respectively, L108 and V544, L108 and S550, L108 and Q558, V112 and N221, V112 and A300, V112 and T319, V112 and P379, V112 and V483 of SEQ ID NO: 160 or I483 of SEQ ID NO: 81, respectively, V112 and V544, V112 and S550, V112 and Q558, N221 and A300, N221 and T319, N221 and P379, N221 V483 of SEQ ID NO: 160 or I483 of SEQ ID NO: 81, respectively, N221 and V544, N221 and S550, N221 and Q558, A300 and T319, A300 and P379, A300 and V483 of SEQ ID NO: 160 or I483 of SEQ ID NO: 81, respectively, A300 and V544, A300 and S550, A300 and Q558, T319 and P379, T319 and V483 of SEQ ID NO: 160 or I483 of SEQ ID NO: 81, respectively, T319 and V544, T319 and S550, T319 and Q558, P379 and V483 of SEQ ID NO: 160 or I483 of SEQ ID NO: 81, respectively, P379 and V544, P379 and S550, P379 and Q558, V483 of SEQ ID NO: 160 or I483 of SEQ ID NO: 81, respectively, and V544, V483 of SEQ ID NO: 160 or I483 of SEQ ID NO: 81, respectively, and S550, V483 of SEQ ID NO: 160 or I483 of SEQ ID NO: 81, respectively, and Q558, V544 and S550, V544 and Q558, and S550 and Q558.

In a 14th embodiment of the 14th aspect which is also an embodiment of any of the previous embodiments of the 14th aspect, the pair of two amino acid positions is selected from the group consisting of L108 and T319, L108 and P379, L108 and V483 of SEQ ID NO: 160 or I483 of SEQ ID NO: 81, respectively, L108 and S550, L108 and Q558, N221 and T319, N221 and P379, N221 and V483 of SEQ ID NO: 160 or I483 of SEQ ID NO: 81, respectively, N221 and V544, N221 and S550, N221 and Q558, T319 and P379, T319 and V483 of SEQ ID NO: 160 or I483 of SEQ ID NO: 81, respectively, T319 and V544, T319 and S550, T319 and Q558, P379 and V483 of SEQ ID NO: 160 or I483 of SEQ ID NO: 81, respectively, P379 and V544, P379 and S550, P379 and Q558, V483 of SEQ ID NO: 160 or I483 of SEQ ID NO: 81, respectively, and V544, V483 of SEQ ID NO: 160 or I483 of SEQ ID NO: 81, respectively, and S550, V483 of SEQ ID NO: 160 or I483 of SEQ ID NO: 81, respectively, and Q558, and S550 and Q558.

In a 15th embodiment of the 14th aspect which is also an embodiment of any other of the previous embodiments of the 14th aspect, in addition to the substitution at the two amino acid positions, the amino acid sequence of the trehalose phosphorylase comprises an amino acid substitution at at least one or more additional amino acid positions, wherein the one or more additional amino acid position is selected from the group consisting of amino acid positions 108, 112, 221, 300, 319, 345, 379, 483, 544, 550, 558, 584, 643, and 707 of SEQ ID NO: 81 or SEQ ID NO: 160, preferably SEQ ID NO: 160, preferably, in addition to the substitution at the two amino acid positions, the amino acid sequence of the trehalose phosphorylase comprises an amino acid substitution at at least one or more additional amino acid positions, wherein the one or more additional amino acid position is selected from the group consisting of amino acid positions 108, 112, 221, 300, 319, 379, 483, 544, 550, and 558 of SEQ ID NO: 81 or SEQ ID NO: 160, preferably SEQ ID NO: 160, more preferably, in addition to the substitution at the two amino acid positions, the amino acid sequence of the trehalose phosphorylase comprises an amino acid substitution at at least one or more additional amino acid positions, wherein the one or more additional amino acid position is selected from the group consisting of amino acid positions 108, 221, 319, 379, 483, 550, and 558 of SEQ ID NO: 81 or SEQ ID NO: 160, preferably SEQ ID NO: 160.

In an 16th embodiment of the 14th aspect which is also an embodiment of another embodiment of the 14th aspect, the one or more additional amino acid position is selected from the group consisting of amino acid positions L108, V112, N221, A300, T319, F345, P379, and V483 of SEQ ID NO: 160 or I483 of SEQ ID NO: 81, respectively, V544, S550, Q558, N584, A643, and L707 of of SEQ ID NO: 81 or SEQ ID NO: 160, preferably SEQ ID NO: 160, preferably, in addition to the substitution at the two amino acid positions, the amino acid sequence of the trehalose phosphorylase comprises an amino acid substitution at at least one or more additional amino acid positions, wherein the one or more additional amino acid position is selected from the group consisting of amino acid positions L108, V112, N221, A300, T319, P379, and V483 of SEQ ID NO: 160 or I483 of SEQ ID NO: 81, respectively, V544, S550, and Q558 of SEQ ID NO: 81 or SEQ ID NO: 160, preferably SEQ ID NO: 160, more preferably, in addition to the substitution at the two amino acid positions, the amino acid sequence of the trehalose phosphorylase comprises an amino acid substitution at at least one or more additional amino acid positions, wherein the one or more additional amino acid position is selected from the group consisting of amino acid positions L108, V221, T319, P379, and V483 of SEQ ID NO: 160 or I483 of SEQ ID NO: 81, respectively, S550, and Q558 of SEQ ID NO: 81 or SEQ ID NO: 160, preferably SEQ ID NO: 160.

In a 17th embodiment of the 14th aspect which is also an embodiment of any other of the previous embodiments of the 14th aspect, the substitution at any of the amino acid positions is selected from the group of amino acids consisting of A, R, N, D, C, Q, E, G, H, I, L, K, M, F, P, S, T, W, Y, and V, preferably the substitution at any of the amino acid positions is individually and independently selected from the group of amino acids consisting of A, R, N, D, C, Q, E, G, H, I, L, K, M, F, P, S, T, W, Y, and V.

In a 18th embodiment of the 14th aspect which is also an embodiment of the twelfth embodiment of the 14th aspect or of any other of the previous embodiments of the 14th aspect, the substitution is at any of amino acid position of SEQ ID NO: 81 or SEQ ID NO: 160, preferably SEQ ID NO: 160 108, 112, 221, 300, 319, 345, 379, 483, 544, 550, 558, 584, 643, and 707.

In a 19th embodiment of the 14th aspect which is also an embodiment of the 13th embodiment of the 14th aspect or of any other of the previous embodiments of the 14th aspect, the substitution is at any of amino acid position of SEQ ID NO: 81 or SEQ ID NO: 160, preferably SEQ ID NO: 160 L108, V112, N221, A300, T319, F345, P379, V483, V544, S550, Q558, N584, A643, and L707.

In a 20th embodiment of the 14th aspect which is also an embodiment of any other of the previous embodiments of the 14th aspect, the amino acid sequence of the trehalose phosphorylase comprises one or more substitutions, wherein the substitution is selected from the group consisting of an amino acid substitution at position L108 of SEQ ID NO: 81 or SEQ ID NO: 160, preferably SEQ ID NO: 160 with the substitution being L108A, L108G, L108I, L108M, L108P or L108V, preferably L108I;

an amino acid substitution at position V112 of SEQ ID NO: 81 or SEQ ID NO: 160, preferably SEQ ID NO: 160 with the substitution being V112A, V112G, V112L, V112M, V112P or V112I, preferably V112I;

an amino acid substitution at position N221 of SEQ ID NO: 81 or SEQ ID NO: 160, preferably SEQ ID NO: 160 with the substitution being N221A, N221G, N221I, N221L, N221M, N221P or N221V, preferably N221I, N221L, N221M or N221V, and more preferably N221V;

an amino acid substitution at position A300 of SEQ ID NO: 81 or SEQ ID NO: 160, preferably SEQ ID NO: 160 with the substitution being A300G, A300I, A300L, A300M, A300P or A300V, preferably A300I or A300L, and more preferably A300I;

an amino acid substitution at position T319 of SEQ ID NO: 81 or SEQ ID NO: 160, preferably SEQ ID NO: 160 with the substitution being T319A, T319G, T319I, T319L, T319M, T319P, or T319V, preferably T319I or T319V, and more preferably T319I;

an amino acid substitution at position P379 of SEQ ID NO: 81 or SEQ ID NO: 160, preferably SEQ ID NO: 160 with the substitution being P379A, P379G, P379I, P379L, P379M, P379V, P379N, P379C, P379Q, P379S or P379T, preferably P379A, P379G, P379M, P379V, P379N, P379C, P379Q, P379S or P379T, more preferably P379G, P379V, P379C, P379S, or P379T, even more preferably P379V or P379T, and most preferably P379V;

an amino acid substitution at position I483 of SEQ ID NO: 81 with the substitution being I483A, I483G, I483I, I483L, I483M, I483P or I483V, preferably I483A, I483G, I483L, I483M or I483V, more preferably I483A;

an amino acid substitution at position V483 of SEQ ID NO: 160 with the substitution being V483A, V483G, V483I, V483L, V483M, or V483P, preferably V483A, V483G, V483L, or V483M, more preferably V483A;

an amino acid substitution at position V544 of SEQ ID NO: 81 or SEQ ID NO: 160, preferably SEQ ID NO: 160 with the substitution being V544A, V544G, V544I, V544L, V544M or V544P, preferably V544I or V544P, and more preferably V544I;

an amino acid substitution at position S550 of SEQ ID NO: 81 or SEQ ID NO: 160, preferably SEQ ID NO: 160 with the substitution being S550N, S550C, S550Q or S550T, preferably S550T;

an amino acid substitution at position Q558 of SEQ ID NO: 81 or SEQ ID NO: 160, preferably SEQ ID NO: 160 with the substitution being Q558D or Q558E, preferably Q558E;

an amino acid substitution at position D558 of SEQ ID NO: 81 or SEQ ID NO: 160, preferably SEQ ID NO: 160 with the substitution being D558N, D558C, D558Q, D558S, D558T, D558A, D558G, D558I, D558L, D558M, D558P or D558V, preferably D558N, D558G or D558A, and more preferably D558N;

an amino acid substitution at position A643 of SEQ ID NO: 81 or SEQ ID NO: 160, preferably SEQ ID NO: 160 with the substitution being A643D or A643E, preferably A643E; an amino acid substitution at position L707 of SEQ ID NO: 81 or SEQ ID NO: 160, preferably SEQ ID NO: 160 with the substitution being L707A, L707G, L707I, L707M, L707P or L707V, preferably L707M.

In a 21$^{th}$ embodiment of the 14$^{th}$ aspect which is also an embodiment of any other of the previous embodiments of the 14$^{th}$ aspect, the identity of the amino acid sequence of the trehalose phosphorylase with the amino acid sequence of SEQ ID NO: 81 or SEQ ID NO: 160, preferably SEQ ID NO: 160 is at least 85%, still more preferably at least 86%, or at least 87%, or at least 88%, or at least 89%, or at least 90%, yet more preferably at least 91%, or at least 92%, or at least 93%, or at least 94%, or at least 95%, and most preferably at least 96%, or at least 97%, or at least 98%, or at least 99%, at least 99.1%, or at least 99.2%, or at least 99.3%, or at least 99.4%, or at least 99.5%, or at least 99.6%, or at least 99.7%, or at least 99.8%, and in particular at least 99.9%, or 100%.

In an 22$^{st}$ embodiment of the 14$^{th}$ aspect which is also an embodiment of any other of the previous embodiments of the 14$^{th}$ aspect, the amino acid sequence of the trehalose phosphorylase is at least 85% identical to an amino acid sequence of SEQ ID NO: 161, 162, 163, 164, 165, 166, 167, 168, 169, 170, 171, 172, 173, 174, 175, 176, 177, 178, 179, 180, 181, 182, 183, 184, 185, 186, 187, 188, 189, preferably according to any one of SEQ ID NO: 163, 165, 166, 168, 171, 173, 176, 177, 178, 179, 180, 184, 185, 186, 187, 188, 189, 2, 84, 85, 87, 88, 89, 91, 92, 93, 94, 95, 97, 98, 99, 100, 101, 102, 103, 104, 105, 106, 107, 109, more preferably according to any one of SEQ ID NO: 176, 178, 180, 185, 188.

In an 23$^{th}$ embodiment of the 14$^{th}$ aspect which is also an embodiment of the 17$^{th}$ embodiment or of any other of the previous embodiments of the 14$^{th}$ aspect, the identity of the amino acid sequence is at least 86%, or at least 87%, or at least 88%, or at least 89%, or at least 90%, more preferably at least 91%, or at least 92%, or at least 93%, or at least 94%, or at least 95%, and most preferably at least 96%, or at least 97%, or at least 98%, or at least 99%, at least 99.1%, or at least 99.2%, or at least 99.3%, or at least 99.4%, or at least 99.5%, or at least 99.6%, or at least 99.7%, or at least 99.8%, and in particular at least 99.9%, or 100%.

In a 24$^{th}$ embodiment of the 14$^{th}$ aspect which is also an embodiment of any other of the previous embodiments of the 14$^{th}$ aspect, the polypeptide, preferably the trehalose phosphorylase, is capable of catalyzing the reaction of a glycosyl monosaccharide and alpha-D-glucose-1 phosphate.

In a 25$^{th}$ embodiment of the 14$^{th}$ aspect which is also an embodiment of the 19$^{th}$ embodiment of the 14$^{th}$ aspect, the polypeptide, preferably the trehalose phosphorylase is capable of catalyzing conversion of glucose and alpha-D-glucose-1 phosphate to trehalose and inorganic phosphate and/or conversion of trehalose and inorganic phosphate to glucose and alpha-D-glucose-1 phosphate.

In a 26$^{st}$ embodiment of the 14$^{th}$ aspect which is also an embodiment of the 19$^{th}$ and 20$^{th}$ embodiment of the 14$^{th}$ aspect, the conversion is a reversible conversion.

In a 27$^{nd}$ embodiment of the 14$^{th}$ aspect which is also an embodiment of any other of the previous embodiments of the 14$^{th}$ aspect, the polypeptide, preferably the trehalose phosphorylase is a trehalose phosphorylase according to EC number EC 2.4.1.231.

In a 28$^{rd}$ embodiment of the 14$^{th}$ aspect which is also an embodiment of any other of the previous embodiments of the 14$^{th}$ aspect, the polypeptide, preferably the trehalose phosphorylase, is characterized by a thermal stability after incubation at 52.5° C. for 15 minutes defined by a residual activity of 15% to 100%, preferably from 30% to 100%, more preferably 50% to 100%, and most preferably from 70% to 100%.

More specifically, these and other problems are solved in a 15$^{th}$ aspect, which is also the first embodiment of the 15$^{th}$ aspect, by a polypeptide, preferably a trehalose phosphorylase, comprising an amino acid sequence, wherein the amino acid sequence of the polypeptide, preferably of the trehalose phosphorylase, is at least 85% identical to and/or at least 85% homologous to an amino acid sequence of SEQ ID NO: 81 or SEQ ID NO: 160, preferably SEQ ID NO: 160, wherein the polypeptide, preferably trehalose phosphorylase, is characterized by a thermal stability after incubation at 52.5° C. for 15 minutes defined by a residual activity of 15% to 100%, preferably from 30% to 100%, more preferably 50% to 100%, and most preferably from 70% to 100%.

In a second embodiment of the 15$^{th}$ aspect, which is also an embodiment of the first embodiments of the 15$^{th}$ aspect, the polypeptide, preferably the trehalose phosphorylase is defined as in any one of embodiments of the 14$^{th}$ aspect.

In a preferred embodiment of the second embodiment of the 15$^{th}$ aspect, the polypeptide, preferably the trehalose phosphorylase is defined as in any one of embodiments of the 14$^{th}$ aspect, preferably the fifth embodiment of the 14$^{th}$ aspect.

In a preferred embodiment of the second embodiment of the 15$^{th}$ aspect, the polypeptide, preferably the trehalose phosphorylase is defined as in any one of embodiments of the 14$^{th}$ aspect, preferably the sixth embodiment of the 14$^{th}$ aspect.

In a third embodiment of the 15$^{th}$ aspect, which is also an embodiment of any other of the embodiments of the 14$^{th}$ and 15th aspect the polypeptide, preferably the trehalose phosphorylase, is characterized by a thermal stability after incubation at 52.5° C. for 15 minutes defined by a residual activity of 30% to 100%, more preferably 50% to 100%, and most preferably from 70% to 100%.

In a preferred embodiment of the third embodiment of the 15th aspect, the polypeptide, preferably the trehalose phosphorylase is defined as in any one of embodiments of the 14th aspect, preferably the fifth embodiment of the 14th aspect.

In a preferred embodiment of the third embodiment of the 15th aspect, the polypeptide, preferably the trehalose phosphorylase is defined as in any one of embodiments of the 14th aspect, preferably the sixth embodiment of the 14th aspect.

In an fourth embodiment of the 15th aspect which is also an embodiment of any other of the embodiments of the 14th and 15th aspect, wherein the polypeptide, preferably the trehalose phosphorylase, is capable of catalyzing reaction of a glucosyl monosaccharide and alpha-D-glucose-1 phosphate.

In an fifth embodiment of the 15th aspect which is also an embodiment of any of the embodiment of the 14th and 15th aspect, the polypeptide, preferably the trehalose phosphorylase, is capable of catalyzing conversion of glucose and alpha-D-glucose-1 phosphate to trehalose and inorganic phosphate and/or conversion of trehalose and inorganic phosphate to glucose and alpha-D-glucose-1 phosphate.

In a sixth embodiment of the 15th aspect which is also an embodiment of the fourth and sixth embodiment of the 15th aspect or any of the embodiment of the 14th and 15th aspect, the conversion is a reversible conversion.

In a seventh embodiment of the 15th aspect which is also an embodiments of any of the embodiments of the 14th and 15th aspect, the polypeptide, preferably the trehalose phosphorylase, is a trehalose phosphorylase according to EC number EC 2.4.1.231.

More specifically, these and other problems are solved in a fifth aspect, which is also the first embodiment of the fifth aspect, by a thermally stable variant of a trehalose phosphorylase comprising an amino acid sequence of SEQ ID NO: 1, or SEQ ID NO: 160, or SEQ ID NO: 81, wherein the variant has a residual activity of at least 30% after incubation at 52° C. for 15 minutes, and the initial activity is determined after incubation for 15 minutes at room temperature.

In a preferred embodiment of the first embodiment of the fifth aspect of the invention the thermally stable variant of a trehalose phosphorylase comprises an amino acid sequence of SEQ ID NO: 1, wherein the variant has a residual activity of at least 30% after incubation at 52° C. for 15 minutes, and the initial activity is determined after incubation for 15 minutes at room temperature.

In another preferred embodiment of the first embodiment of the fifth aspect of the invention the thermally stable variant of a trehalose phosphorylase comprises an amino acid sequence of SEQ ID NO:160, wherein the variant has a residual activity of at least 30% after incubation at 52° C. for 15 minutes, and the initial activity is determined after incubation for 15 minutes at room temperature.

In a preferred embodiment of the first embodiment of the fifth aspect of the invention the thermally stable variant of a trehalose phosphorylase comprises an amino acid sequence of SEQ ID NO:81, wherein the variant has a residual activity of at least 30% after incubation at 52° C. for 15 minutes, and the initial activity is determined after incubation for 15 minutes at room temperature.

In a second embodiment of fourth aspect and the fifth aspect, which are also embodiments of the first embodiment of the fourth aspect and the first embodiment of the fifth aspect and also an embodiment of any other of the previous embodiments of the fourth aspect and of the fifth aspect, the variant retains at least 50% of its initial activity after incubation for 15 minutes at 52° C. in a buffer containing 1 M sucrose, and the initial activity is determined after incubation for 15 minutes at room temperature.

In a 23rd embodiment of the second aspect, which is also a 3rd embodiment of the third aspect, a third embodiment of the fourth aspect, and a third embodiment of the fifth aspect, and another embodiment of the 15th aspect, or of any one of the previous embodiments of the second, third, fourth, fifth or 15th aspect, the polypeptide, preferably the trehalose phosphorylase, comprises (i) an amino acid sequence as defined in any one of embodiments 1 to 120 or of any other of the embodiments of the first aspect, preferably as defined in any one of embodiments 1 to 98 of the first aspect of the invention, and/or (ii) an amino acid sequence as defined in any one of embodiments of the 14th aspect of the invention and/or (iii) an amino acid sequence as defined in any one of embodiments of the 13th aspect of the invention.

More specifically, these and other problems are solved in a 16th aspect, which is also the first embodiment of the 16th aspect, and which is also a preferred embodiment of all aspects of the invention and of all embodiments of any of all aspects of the invention, and in particular in any embodiment of the first, second, third, fourth, fifth, 13th, 14th, and 15th, aspect of the invention as disclosed herein, by the polypeptide, preferably the trehalose phosphorylase, wherein the polypeptide, preferably of the trehalose phosphorylase, is an enzymatically active fragment of the polypeptide, preferably of the trehalose phosphorylase of the invention, as defined in any aspect or in any of the preferred embodiments of an aspect described herein and/or above.

In a preferred embodiment of this 16th aspect, which is also an embodiment of any of the previous embodiments of the 16th aspect, the trehalose phosphorylase is an enzymatically active fragment of the polypeptide, preferably of the trehalose phosphorylase of the invention, with a length of at least 400 up to 750 amino acids, or at least 450 up to 750 amino acids, or at least 500 up to 750 amino acids, or at least 550 up to 750 amino acids, or at least 600 up to 750 amino acids, or at least 650 up to 750 amino acids, or at least 700 up to 750 amino acids, or at least 700 up to 730.

In a preferred embodiment of this 16th aspect, which is also an embodiment of any of the previous embodiments of the 16th aspect, the polypeptide is an enzymatically active fragment of the polypeptide, preferably of the trehalose phosphorylase of the invention, wherein the trehalose phosphorylase is (i) truncated at its N-terminus by at least 1 up to 37 amino acids, by at least 1 to 87 amino acids, by at least 1 up to 137 amino acids, by at least 1 up to 187 amino acids, by at least 1 up to 237 amino acids, by at least 1 up to 287 amino acids, by at least 1 up to 337 amino acids; and/or (ii) truncated at its C-terminus by at least 1 up to 37 amino acids, by at least 1 up to 87 amino acids, by at least 1 up to 137 amino acids, by at least 1 up to 187 amino acids, by at least 1 up to 237 amino acids, by at least 1 up to 287 amino acids, by at least 1 up to 337 amino acids; and/or (iii) truncated at one or more internal positions, wherein each one or more internal positions carries deletions of 1, 2, 3, 4, 5, 6, 7, 8, 9, 10, or at least 10 up to 15, at least 15 up to 20, at least 20 up to 25, at least 25 up to 30, at least 30 up to 35, at least 35 up to 40, at least 40 up to 45, or at least 45 up to 50 amino acids.

In a preferred embodiment of this $16^{th}$ aspect, which is also an embodiment of any of the previous embodiments of the $16^{th}$ aspect, the polypeptide, preferably the trehalose phosphorylase of the invention, is an enzymatically active fragment of the polypeptide, preferably of the trehalose phosphorylase of the invention, which retains trehalose phosphorylase activity, according to any of the embodiments as defined herein and/or above.

More specifically, these and other problems are solved in a sixth aspect, which is also the first embodiment of the sixth aspect, by a method for reacting a glucosyl monosaccharide and alpha-D-glucose-1 phosphate
wherein the method comprises reacting
the glucosyl monosaccharide and alpha-D-glucose-1 phosphate
with a trehalose phosphorylase as defined in any embodiment of the first, second, third, fourth, fifth, $13^{th}$, $14^{th}$, $15^{th}$, and $16^{th}$ aspect of the invention as disclosed herein.

More specifically, these and other problems are solved in a seventh aspect, which is also the first embodiment of the seventh aspect, by a method for converting glucose and alpha-D-glucose-1 phosphate into trehalose and inorganic phosphate, wherein the method comprises reacting glucose and alpha-D-glucose-1 phosphate to trehalose and inorganic phosphate with a trehalose phosphorylase as defined in any embodiment of the first, second, third, fourth, fifth, $13^{th}$, $14^{th}$, $15^{th}$ and $16^{th}$ aspect of the invention as disclosed herein.

More specifically, these and other problems are solved in an eighth aspect, which is also the first embodiment of the eighth aspect, by a method for converting trehalose and inorganic phosphate into glucose and alpha-D-glucose-1 phosphate, and wherein the method comprises reacting trehalose and inorganic phosphate to glucose and alpha-D-glucose-1 phosphate with a trehalose phosphorylase as defined in any embodiment of the first, second, third, fourth, fifth, $13^{th}$, $14^{th}$, $15^{th}$, and $16^{th}$ aspect of the invention as disclosed herein.

In a second embodiment of the sixth aspect and a second embodiment of the seventh aspect and in a second aspect of the eighth aspect, which are also embodiments of the first embodiment of the sixth aspect and of the first embodiment of the seventh aspect and of the first embodiment of the eighth aspect, the reaction is reversible.

More specifically, these and other problems are solved in a ninth aspect, which is also the first embodiment of the ninth aspect, by a method for preparing trehalose comprising reacting glucose and alpha-D-glucose-1 phosphate at a temperature of at least 40° C. in the presence of a trehalose phosphorylase, wherein the trehalose phosphorylase (i) retains at least 30% of its activity after incubation for 15 minutes at 52° C. in a buffer containing 1 M sucrose compared to its activity without thermal treatment, and/or
(ii) retains at least 50% of its activity after incubation for 15 minutes at 52° C. in a buffer containing 1 M sucrose compared to its activity without thermal treatment, and/or
(iii) has a ratio of activity at 100 mM glucose to activity at 500 mM glucose of at least 0.65.

In a second embodiment of the ninth aspect which is also an embodiment of the first embodiment of the ninth aspect, the reaction is performed at from 40 to 55° C.

In a third embodiment of the ninth aspect which is also an embodiment of the first embodiment of the ninth aspect, the reaction is performed at from 45 to 55° C.

In a fourth embodiment of the ninth aspect which is also an embodiment of the first, second and third embodiment of the ninth aspect, the trehalose phosphorylase is a thermally stable trehalose phosphorylase.

In a fifth embodiment of the ninth aspect which is also an embodiment of the first, second, third and fourth embodiment of the ninth aspect, the trehalose phosphorylase is a mutant trehalose phosphorylase.

In a sixth embodiment of the ninth aspect which is also an embodiment of the first, second, third, fourth and fifth embodiment of the ninth aspect, the trehalose phosphorylase is a recombinant trehalose phosphorylase.

In a seventh embodiment of the ninth aspect which is also an embodiment of the first, second, third, fourth, fifth and sixth embodiment of the ninth aspect, the activity is determined as disclosed herein.

In a further embodiment of the sixth aspect which is an embodiment of each and any embodiment of the sixth aspect, in a further embodiment of the seventh aspect which is an embodiment of each and any embodiment of the seventh aspect, in a further embodiment of the eighth aspect which is an embodiment of each and any embodiment of the eighth aspect, and in a further embodiment of the ninth aspect which is an embodiment of each and any embodiment of the ninth aspect, wherein the only stabilizing agent contained in the reaction is sucrose.

In a further embodiment of the sixth aspect which is an embodiment of each and any embodiment of the sixth aspect, in a further embodiment of the seventh aspect which is an embodiment of each and any embodiment of the seventh aspect, in a further embodiment of the eighth aspect which is an embodiment of each and any embodiment of the eighth aspect, and in a further embodiment of the ninth aspect which is an embodiment of each and any embodiment of the ninth aspect, the trehalose phosphorylase is present in non-immobilized form.

In a further embodiment of the sixth aspect which is an embodiment of each and any embodiment of the sixth aspect, in a further embodiment of the seventh aspect which is an embodiment of each and any embodiment of the seventh aspect, in a further embodiment of the eighth aspect which is an embodiment of each and any embodiment of the eighth aspect, and in a further embodiment of the ninth aspect which is an embodiment of each and any embodiment of the ninth aspect, the trehalose phosphorylase is a trehalose phosphorylase as defined in any embodiments one of the first, second, third, fourth, fifth, $13^{th}$, $14^{th}$, $15^{th}$, and 16th aspect, including any embodiments thereof, as disclosed herein.

More specifically, these and other problems are solved in a tenth aspect, which is also the first embodiment of the tenth aspect, by the use of a trehalose phosphorylase of any embodiments one of the first, second, third, fourth, fifth, $13^{th}$, $14^{th}$, $15^{th}$, and $16^{th}$ aspect as disclosed herein for producing trehalose.

More specifically, these and other problems are solved in an eleventh aspect, which is also the first embodiment of the eleventh aspect, by a method for increasing thermal stability of a trehalose phosphorylase, wherein the method comprises:

aligning an amino acid sequence of a first trehalose phosphorylase with an amino acid sequence of a second trehalose phosphorylase, identifying one or more amino acid positions of the amino acid sequence of the second trehalose phosphorylase which correspond to one or more amino acid positions of the amino acid sequence of the first trehalose phosphorylase, wherein substitution of an amino acid residue at the one or more amino acid position of the amino acid sequence of the first trehalose phosphorylase increases thermal stability of the first trehalose phosphorylase, substituting an amino acid residue at the one or more amino acid positions of the second trehalose phosphorylase corresponding to the one or more amino acid positions of the amino acid sequence of the first trehalose phosphorylase, wherein substitution of an amino acid residue at the one or more amino acid position of the amino acid sequence of the first trehalose phosphorylase increases thermal stability of the first trehalose phosphorylase;

wherein the first trehalose phosphorylase is a trehalose phosphorylase comprising an amino acid sequence according to SEQ ID NO: 1 or according to SEQ ID NO: 160, preferably according to SEQ ID NO: 1.

In a second embodiment of the eleventh aspect which is also an embodiment of the first embodiment of the eleventh aspect, the method further comprises testing whether the substituted amino acid residue at the one or more amino acid positions of the second trehalose phosphorylase corresponding to the one or more amino acid positions of the amino acid sequence of the first trehalose phosphorylase, results in increased thermal stability of the second trehalose phosphorylase compared to the thermal stability of the first trehalose phosphorylase, preferably thermal stability is determined as defined in the description herein.

In a third embodiment of the eleventh aspect which is also an embodiment of the first and second embodiment of the eleventh aspect, the amino acid residue at the one or more amino acid positions of the second trehalose phosphorylase corresponding to the one or more amino acid positions of the amino acid sequence of the first trehalose phosphorylase, is substituted such that the substituted amino acid residue results in increased thermal stability of the second trehalose phosphorylase.

In a fourth embodiment of the eleventh aspect which is also an embodiment of the first, second and third embodiment of the eleventh aspect, the homology between the amino acid sequence of the first trehalose phosphorylase and the amino acid sequence of the second trehalose phosphorylase is at least 50%.

In a fifth embodiment of the eleventh aspect which is also an embodiment of the fourth embodiment of the eleventh aspect, the homology is at least 51%, 52%, 53%, 54%, 55%, 56%, 57%, 58%, 59%, 60%, 61%, 62%, 63%, 64%, 65%, 66%, 67%, 68%, 69%, 70,%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%, preferably the homology is at least 55%, 60%, 63%, 65%, 68%, 70%, 75%, 77% or 80%.

In a sixth embodiment of the eleventh aspect which is also an embodiment of the first, second and third embodiment of the eleventh aspect, the identity between the amino acid sequence of the first trehalose phosphorylase and the amino acid sequence of the second trehalose phosphorylase is at least 50%.

In a seventh embodiment of the eleventh aspect which is also an embodiment of the sixth embodiment of the eleventh aspect, the identity is at least 51%, 52%, 53%, 54%, 55%, 56%, 57%, 58%, 59%, 60%, 61%, 62%, 63%, 64%, 65%, 66%, 67%, 68%, 69%, 70,%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%, preferably, the identity is at least 55%, 60%, 63%, 65%, 68%, 70%, 75%, 77% or 80%, and more preferably the identity is at least 68%, 73%, 75%, 76%, 77% or 78%.

In an eighth embodiment of the eleventh aspect which is also an embodiment of the first, second, third, fourth, fifth, sixth and seventh embodiment of the eleventh aspect, the one or more amino acid positions of the amino acid sequence of the first trehalose phosphorylase (A) is selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1, preferably the one or more amino acid positions of the amino acid sequence of the first trehalose phosphorylase is each and individually selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1, preferably selected from the group consisting of amino acid positions 712, 383, 114, 118, 225, 304, 323, 349, 357, 487, 550, 556, 564, 590 and 649 more preferably selected from the group consisting of amino acid positions 712, 383, 114, 118, 225, 304, 323, 349, 487, 550, 556, 564, 590, and 649 SEQ ID NO: 1, even more preferably selected from the group consisting of amino acid positions of 383, 114, 118, 225, 304, 323, 487, 550, 556, and 564 SEQ ID NO: 1, and even more preferably selected from the group consisting of amino acid positions 383, 114, 225, 323, 487, 556, and 564 of SEQ ID NO: 1, or (B) is selected from the group consisting of amino acid positions 108, 112, 221, 300, 319, 345, 379, 483, 544, 550, 558, 584, 643, and 707 of SEQ ID NO:81 or SEQ ID NO: 160, preferably of SEQ ID NO: 160, preferably the one or more amino acid positions of the amino acid sequence of the first trehalose phosphorylase is each and individually selected from the group consisting of amino acid positions 108, 112, 221, 300, 319, 345, 379, 483, 544, 550, 558, 584, 643, and 707 of SEQ ID NO:81 or SEQ ID NO: 160, preferably of SEQ ID NO: 160, preferably selected from the group consisting of amino acid positions 108, 112, 221, 300, 319, 379, 483, 544, 550, and 558 of SEQ ID NO:81 or SEQ ID NO: 160, preferably of SEQ ID NO: 160, more preferably selected from the group consisting of amino acid positions of 108, 221, 319, 379, 483, 550, and 558 of SEQ ID NO:81 or SEQ ID NO: 160, preferably SEQ ID NO: 160.

In a ninth embodiment of the eleventh aspect which is also an embodiment of the eighth embodiment of the eleventh aspect, the one or more amino acid positions of the amino acid sequence of the first trehalose phosphorylase (A) is selected from the group consisting of amino acid positions L712, P383, V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705 of SEQ ID NO: 1, preferably the one or more amino acid positions of the amino acid sequence of the first trehalose phosphorylase is each and individually selected from the group consisting of amino acid positions L712, P383, V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705 of SEQ ID NO: 1, preferably selected from the group consisting of amino acid positions L712, P383, L114, I118, N225, A304, T323, F349, Q487, V550, S556, T564, D590, and A649 SEQ ID NO: 1, more preferably selected from the group consisting of P383, L114, I118, N225, A304, T323, Q487, V550, S556, and T564 of SEQ ID NO: 1, and even more preferably selected from the group consisting of amino acid positions P383, L114, N225, A323, Q487, S556, and T564 of SEQ ID NO: 1, or (B) is selected from the group consisting of amino acid positions L108, V112, N221, A300, T319, F345, P379, V483, V544, S550, Q558, N584, A643, and L707 of SEQ ID NO: 160, preferably the one or more amino acid positions of the amino acid sequence of the first trehalose phosphorylase is each and individually selected from the group consisting of amino acid positions L108, V112, N221, A300, T319, F345, P379, V483, V544, S550, Q558, N584, A643, and L707 of SEQ ID NO: 160, preferably selected from the group consisting of amino acid positions L108, V112, N221, A300, T319, P379, V483, V544, S550, and Q558 of SEQ ID NO: 160, more preferably selected from the group consisting of L108, V221, T319, P379, V483, S550, and Q558 of SEQ ID NO: 160.

(C) is selected from the group consisting of amino acid positions L108, V112, N221, A300, T319, F345, P379, I483, V544, S550, Q558, N584, A643, and L707 of SEQ ID NO: 81, preferably the one or more amino acid positions of the amino acid sequence of the first trehalose phosphorylase is each and individually selected from the group consisting of amino acid positions L108, V112, N221, A300, T319, F345, P379, I483, V544, S550, Q558, N584, A643, and L707 of SEQ ID NO: 81, preferably selected from the group consisting of amino acid positions L108, V112, N221, A300, T319, P379, I483, V544, S550, and Q558 of SEQ ID NO: 81, more preferably selected from the group consisting of L108, V221, T319, P379, I483, S550, and Q558 of SEQ ID NO: 81.

In a tenth embodiment of the eleventh aspect which is also an embodiment of the first, second, third, fourth, fifth, sixth, seventh, eighth and ninth embodiment of the eleventh aspect, the substituted amino acid residue is (A) for SEQ ID NO: 1:

A, G, I, M, P, V, preferably M for the amino acid position of the second trehalose phosphorylase corresponding to amino acid position 712 of SEQ ID NO:1 of the first trehalose phosphorylase;

A, G, I, L, M, V, N, C, Q, S, T, preferably A, G, M, V, N, C, Q, S, T, more preferably G, V, S or T, even more preferably V or T, and most, preferably V, for the amino acid position of the second trehalose phosphorylase corresponding to amino acid position 383 of SEQ ID NO: 1 of the first trehalose phosphorylase;

R, H or K, preferably R for the amino acid position of the second trehalose phosphorylase corresponding to amino acid position 10 of SEQ ID NO: 1 of the first trehalose phosphorylase;

A, G, I, M, P, V, preferably I for the amino acid position of the second trehalose phosphorylase corresponding to amino acid position 114 of SEQ ID NO: 1 of the first trehalose phosphorylase;

A, G, I, L, M, P, V, preferably V for the amino acid position of the second trehalose phosphorylase corresponding to amino acid position 118 of SEQ ID NO: 1 of the first trehalose phosphorylase;

A, G, I, L, M, P, V, preferably V for the amino acid position of the second trehalose phosphorylase corresponding to amino acid position 192 of SEQ ID NO: 1 of the first trehalose phosphorylase;

A, G, I, L, M, P, V, preferably G for the amino acid position of the second trehalose phosphorylase corresponding to amino acid position 197 of SEQ ID NO: 1 of the first trehalose phosphorylase;

F, W, preferably F for the amino acid position of the second trehalose phosphorylase corresponding to amino acid position 220 of SEQ ID NO: 1 of the first trehalose phosphorylase;

A, G, I, L, M, P, V, preferably I, L, M or V, and most preferably V for the amino acid position of the second trehalose phosphorylase corresponding to amino acid position 225 of SEQ ID NO: 1 of the first trehalose phosphorylase;

G, I, L, M, P, V, preferably I or L, and more preferably I for the amino acid position of the second trehalose phosphorylase corresponding to amino acid position 304 of SEQ ID NO: 1 of the first trehalose phosphorylase;

R, H, K, preferably H for the amino acid position of the second trehalose phosphorylase corresponding to amino acid position 306 of SEQ ID NO: 1 of the first trehalose phosphorylase;

R, H, K, preferably H for the amino acid position of the second trehalose phosphorylase corresponding to amino acid position 318 of SEQ ID NO: 1 of the first trehalose phosphorylase;

A, G, I, L, M, P, V, preferably I or V, more preferably I for the amino acid position of the second trehalose phosphorylase corresponding to amino acid position 323 of SEQ ID NO: 1 of the first trehalose phosphorylase;

A, G, I, L, M, P, V, preferably I for the amino acid position of the second trehalose phosphorylase corresponding to amino acid position 339 of SEQ ID NO: 1 of the first trehalose phosphorylase;

W or Y, preferably Y for the amino acid position of the second trehalose phosphorylase corresponding to amino acid position 349 of SEQ ID NO: 1 of the first trehalose phosphorylase;

A, I, L, M, P, V, preferably A for the amino acid position of the second trehalose phosphorylase corresponding to amino acid position 357 of SEQ ID NO: 1 of the first trehalose phosphorylase;

N, C, Q, S, T, preferably S for the amino acid position of the second trehalose phosphorylase corresponding to amino acid position 459 of SEQ ID NO: 1 of the first trehalose phosphorylase;

A, G, I, L, M, P, V, preferably G for the amino acid position of the second trehalose phosphorylase corresponding to amino acid position 476 of SEQ ID NO: 1 of the first trehalose phosphorylase;

A, G, I, L, M, P, V, preferably I for the amino acid position of the second trehalose phosphorylase corresponding to amino acid position 481 of SEQ ID NO: 1 of the first trehalose phosphorylase;

N, C, Q, S, T, preferably S for the amino acid position of the second trehalose phosphorylase corresponding to amino acid position 484 of SEQ ID NO: 1 of the first trehalose phosphorylase;

A, G, I, L, M, P, V, preferably A, M, G, V or L, more preferably A, for the amino acid position of the second trehalose phosphorylase corresponding to amino acid position 487 of SEQ ID NO: 1 of the first trehalose phosphorylase;

A, G, I, L, M, P, V, preferably A for the amino acid position of the second trehalose phosphorylase corresponding to amino acid position 488 of SEQ ID NO: 1 of the first trehalose phosphorylase;

N, C, Q, S, T, preferably S for the amino acid position of the second trehalose phosphorylase corresponding to amino acid position 506 of SEQ ID NO: 1 of the first trehalose phosphorylase;

N, C, Q, S, T, preferably S for the amino acid position of the second trehalose phosphorylase corresponding to amino acid position 511 of SEQ ID NO: 1 of the first trehalose phosphorylase;

D or E, preferably E for the amino acid position of the second trehalose phosphorylase corresponding to amino acid position 526 of SEQ ID NO: 1 of the first trehalose phosphorylase;

A, G, I, L, M, P, V, preferably V for the amino acid position of the second trehalose phosphorylase corresponding to amino acid position 530 of SEQ ID NO: 1 of the first trehalose phosphorylase;

R, H, K, preferably R for the amino acid position of the second trehalose phosphorylase corresponding to amino acid position 532 of SEQ ID NO: 1 of the first trehalose phosphorylase;

A, G, I, L, M, P, V, preferably G for the amino acid position of the second trehalose phosphorylase corresponding to amino acid position 533 of SEQ ID NO: 1 of the first trehalose phosphorylase;

A, G, I, L, M, P, V, preferably M for the amino acid position of the second trehalose phosphorylase corresponding to amino acid position 537 of SEQ ID NO: 1 of the first trehalose phosphorylase;

A, G, I, L, M, P, preferably I or P, more preferably I for the amino acid position of the second trehalose phosphorylase corresponding to amino acid position 550 of SEQ ID NO: 1 of the first trehalose phosphorylase;

N, C, Q, T, preferably T for the amino acid position of the second trehalose phosphorylase corresponding to amino acid position 556 of SEQ ID NO: 1 of the first trehalose phosphorylase;

D, E, preferably E for the amino acid position of the second trehalose phosphorylase corresponding to amino acid position 564 of SEQ ID NO: 1 of the first trehalose phosphorylase;

N, C, Q, S, T, A, G, I, L, M, P, V, preferably N or A, more preferably N, for the amino acid position of the second trehalose phosphorylase corresponding to amino acid position 590 of SEQ ID NO: 1 of the first trehalose phosphorylase;

D, E, preferably E for the amino acid position of the second trehalose phosphorylase corresponding to amino acid position 649 of SEQ ID NO: 1 of the first trehalose phosphorylase;

D, E, R, H, K, preferably E or K, more preferably E, for the amino acid position of the second trehalose phosphorylase corresponding to amino acid position 667 of SEQ ID NO: 1 of the first trehalose phosphorylase;

D, E, preferably E for the amino acid position of the second trehalose phosphorylase corresponding to amino acid position 703 of SEQ ID NO: 1 of the first trehalose phosphorylase; and N, C, Q, S, T, preferably N for the amino acid position of the second trehalose phosphorylase corresponding to amino acid position 705 of SEQ ID NO: 1 of the first trehalose phosphorylase; or (B) for SEQ ID NO: 81 and SEQ ID NO: 160:

an amino acid substitution at position L108 of SEQ ID NO: 81 or SEQ ID NO: 160, preferably SEQ ID NO: 160 with the substitution being L108A, L108G, L108I, L108M, L108P or L108V, preferably L108I;

an amino acid substitution at position V112 of SEQ ID NO: 81 or SEQ ID NO: 160, preferably SEQ ID NO: 160 with the substitution being V112A, V112G, V112L, V112M, V112P or V112I, preferably V112I;

an amino acid substitution at position N221 of SEQ ID NO: 81 or SEQ ID NO: 160, preferably SEQ ID NO: 160 with the substitution being N221A, N221G, N221I, N221L, N221M, N221P or N221V, preferably N221I, N221L, N221M or N221V, and more preferably N221V;

an amino acid substitution at position A300 of SEQ ID NO: 81 or SEQ ID NO: 160, preferably SEQ ID NO: 160 with the substitution being A300G, A300I, A300L, A300M, A300P or A300V, preferably A300I or A300L, and more preferably A300I;

an amino acid substitution at position T319 of SEQ ID NO: 81 or SEQ ID NO: 160, preferably SEQ ID NO: 160 with the substitution being T319A, T319G, T319I, T319L, T319M, T319P, or T319V, preferably T319I or T319V, and more preferably T319I;

an amino acid substitution at position P379 of SEQ ID NO: 81 or SEQ ID NO: 160, preferably SEQ ID NO: 160 with the substitution being P379A, P379G, P379I, P379L, P379M, P379V, P379N, P379C, P379Q, P379S or P379T, preferably P379A, P379G, P379M, P379V, P379N, P379C, P379Q, P379S or P379T, more preferably P379G, P379V, P379C or P379S, or P379T, even more preferably P379V or P379T, and most preferably P379V;

an amino acid substitution at position I483 of SEQ ID NO: 81 with the substitution being I483A, I483G, I483I, I483L, I483M, I483P or I483V, preferably I483A, I483G, I483L, I483M or I483V, more preferably I483A;

an amino acid substitution at position V483 of SEQ ID NO: 160 with the substitution being V483A, V483G, V483I, V483L, V483M, or V483P, preferably V483A, V483G, V483L, or V483M, more preferably V483A;

an amino acid substitution at position V544 of SEQ ID NO: 81 or SEQ ID NO: 160, preferably SEQ ID NO: 160 with the substitution being V544A, V544G, V544I, V544L, V544M or V544P, preferably V544I or V544P, and more preferably V544I;

an amino acid substitution at position S550 of SEQ ID NO: 81 or SEQ ID NO: 160, preferably SEQ ID NO: 160 with the substitution being S550N, S550C, S550Q or S550T, preferably S550T;

an amino acid substitution at position Q558 of SEQ ID NO: 81 or SEQ ID NO: 160, preferably SEQ ID NO: 160 with the substitution being Q558D or Q558E, preferably Q558E;

an amino acid substitution at position D558 of SEQ ID NO: 81 or SEQ ID NO: 160, preferably SEQ ID NO: 160 with the substitution being D558N, D558C, D558Q, D558S, D558T, D558A, D558G, D558I, D558L, D558M, D558P or D558V, preferably D558N, D558G or D558A, and more preferably D558N;

an amino acid substitution at position A643 of SEQ ID NO: 81 or SEQ ID NO: 160, preferably SEQ ID NO: 160 with the substitution being A643D or A643E, preferably A643E; an amino acid substitution at position L707 of SEQ ID NO: 81 or SEQ ID NO: 160, preferably SEQ ID NO: 160 with the substitution being L707A, L707G, L707I, L707M, L707P or L707V, preferably L707M.

In an eleventh embodiment of the eleventh aspect which is also an embodiment of the first, second, third, fourth, fifth, sixth, seventh, eighth, ninth and tenth embodiment of the eleventh aspect, if the amino acid residue of the second trehalose phosphorylase corresponding to one or more amino acid positions of the amino acid sequence of the first trehalose phosphorylase, is the same as the substituted amino acid residue of the first trehalose phosphorylase, the amino acid residue of the second trehalose phosphorylase is not substituted.

In a twelfth embodiment of the eleventh aspect which is also an embodiment of the first, second, third, fourth, fifth, sixth, seventh, eighth, ninth, tenth and eleventh embodiment of the eleventh aspect, thermal stability is expressed as Tm30 value or Tm50 value as defined in the description.

More specifically, these and other problems are solved in a twelfth aspect, which is also the first embodiment of the twelfth aspect, by a method for increasing the relative activity of a trehalose phosphorylase expressed as 100/500-ratio, wherein the method comprises:
aligning an amino acid sequence of a first trehalose phosphorylase with an amino acid sequence of a second trehalose phosphorylase,
identifying one or more amino acid positions of the amino acid sequence of the second trehalose phosphorylase which correspond to one or more amino acid positions of the amino acid sequence of the first trehalose phosphorylase, wherein substitution of an amino acid residue at the one or more amino acid position of the amino acid sequence of the first trehalose phosphorylase increases the 100/500-ratio of the first trehalose phosphorylase,
substituting an amino acid residue at the one or more amino acid positions of the second trehalose phosphorylase corresponding to the one or more amino acid positions of the amino acid sequence of the first trehalose phosphorylase, wherein substitution of an amino acid residue at the one or more amino acid position of the amino acid sequence of the first trehalose phosphorylase increases the 100/500-ratio activity of the first trehalose phosphorylase;
wherein the first trehalose phosphorylase is a trehalose phosphorylase comprising an amino acid sequence according to SEQ ID NO: 1.

In a second embodiment of the twelfth aspect which is also an embodiment of the first embodiment of the twelfth aspect, the method comprises
testing whether the substituted amino acid residue at the one or more amino acid positions of the second trehalose phosphorylase corresponding to the one or more amino acid positions of the amino acid sequence of the first trehalose phosphorylase, results in increased activity of the second trehalose phosphorylase compared to the activity of the first trehalose phosphorylase.

In a third embodiment of the twelfth aspect which is also an embodiment of the first and second embodiment of the twelfth aspect, the amino acid residue at the one or more amino acid positions of the second trehalose phosphorylase corresponding to the one or more amino acid positions of the amino acid sequence of the first trehalose phosphorylase, is substituted such that the substituted amino acid residue results in increased activity of the second trehalose phosphorylase.

In a fourth embodiment of the twelfth aspect which is also an embodiment of the first, second and third embodiment of the twelfth aspect, the homology between the amino acid sequence of the first trehalose phosphorylase and the amino acid sequence of the second trehalose phosphorylase is at least 50%.

In a fifth embodiment of the twelfth aspect which is also an embodiment of the fourth embodiment of the twelfth aspect, the homology is at least 55%, 56%, 57%, 58%, 59%, 60%, 61%, 62%, 63%, 64%, 65%, 66%, 67%, 68%, 69%, 70,%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%, preferably the homology is at least 55%, 60%, 65%, 70%, 75% or 80%.

In a sixth embodiment of the twelfth aspect which is also an embodiment of the first, second and third embodiment of the twelfth aspect, the identity between the amino acid sequence of the first trehalose phosphorylase and the amino acid sequence of the second trehalose phosphorylase is at least 50%.

In a seventh embodiment of the twelfth aspect which is also an embodiment of the sixth embodiment of the twelfth aspect, the identity is at least 55%, 56%, 57%, 58%, 59%, 60%, 61%, 62%, 63%, 64%, 65%, 66%, 67%, 68%, 69%, 70,%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99%, preferably the identity is at least 55%, 60%, 65%, 70%, 75% or 80%, and more preferably the identity is at least 73%, 75%, 76%, or 78%.

In an eighth embodiment of the twelfth aspect which is also an embodiment of the first, second, third, fourth, fifth, sixth and seventh embodiment of the twelfth aspect, the one or more amino acid positions of the amino acid sequence of the first trehalose phosphorylase is selected from the group consisting of amino acid positions of SEQ ID NO: 1 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705, preferably the one or more amino acid positions of the amino acid sequence of the first trehalose phosphorylase is each and individually selected from the group consisting of amino acid positions of SEQ ID NO: 1 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705, and even more preferably the one or more amino acid positions of the amino acid sequence of the first trehalose phosphorylase is each and individually selected from the group consisting of amino acid positions 712, 383, 114, 118, 225, 304, 323, 349, 357, 487, 550, 556, 564, 590 and 649 of SEQ ID NO: 1.

In a ninth embodiment of the twelfth aspect which is also an embodiment of the eighth embodiment of the twelfth aspect, the one or more amino acid positions of the amino acid sequence of the first trehalose phosphorylase is selected from the group consisting of amino acid positions of SEQ ID NO: 1 L712, P383, V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705, preferably the one or more amino acid positions of the amino acid sequence of the first trehalose phosphorylase is each and individually selected from the group consisting of amino acid positions of SEQ ID NO: 1 L712, P383, V10, L114, I118, S192, S197, Y220, N225, A304, D306, P318, T323, L339, F349, G357, A459, Q476, E481, A484, Q487, K488, A506, A511, R526, E530, G532, D533, D537, V550, S556, T564, D590, A649, R667, A703 and K705.

In a tenth embodiment of the twelfth aspect which is also an embodiment of the first, second, third, fourth, fifth, sixth, seventh, eighth and ninth embodiment of the twelfth aspect, the substituted amino acid residue is

- A, G, I, M, P, V, preferably M for the amino acid position of the second trehalose phosphorylase corresponding to amino acid position 712 of SEQ ID NO:1 of the first trehalose phosphorylase;
- A, G, I, L, M, V, N, C, Q, S, T, preferably A, G, M, V, N, C, Q, S or T, more preferably G, V, C, S or T, even more preferably V or T, and most preferably V, for the amino acid position of the second trehalose phosphorylase corresponding to amino acid position 383 of SEQ ID NO: 1 of the first trehalose phosphorylase;
- R, H or K, preferably R for the amino acid position of the second trehalose phosphorylase corresponding to amino acid position 10 of SEQ ID NO: 1 of the first trehalose phosphorylase;
- A, G, I, M, P, V, preferably I for the amino acid position of the second trehalose phosphorylase corresponding to amino acid position 114 of SEQ ID NO: 1 of the first trehalose phosphorylase;
- A, G, I, L, M, P, V, preferably V for the amino acid position of the second trehalose phosphorylase corresponding to amino acid position 118 of SEQ ID NO: 1 of the first trehalose phosphorylase;
- A, G, I, L, M, P, V, preferably V for the amino acid position of the second trehalose phosphorylase corresponding to amino acid position 192 of SEQ ID NO: 1 of the first trehalose phosphorylase;
- A, G, I, L, M, P, V, preferably G for the amino acid position of the second trehalose phosphorylase corresponding to amino acid position 197 of SEQ ID NO: 1 of the first trehalose phosphorylase;
- F, W, preferably F for the amino acid position of the second trehalose phosphorylase corresponding to amino acid position 220 of SEQ ID NO: 1 of the first trehalose phosphorylase;
- A, G, I, L, M, P, V, preferably, I, L, M or V, and more preferably V for the amino acid position of the second trehalose phosphorylase corresponding to amino acid position 225 of SEQ ID NO: 1 of the first trehalose phosphorylase;
- G, I, L, M, P, V, preferably I or L, and more preferably I for the amino acid position of the second trehalose phosphorylase corresponding to amino acid position 304 of SEQ ID NO: 1 of the first trehalose phosphorylase;
- R, H, K, preferably H for the amino acid position of the second trehalose phosphorylase corresponding to amino acid position 306 of SEQ ID NO: 1 of the first trehalose phosphorylase;
- R, H, K, preferably H for the amino acid position of the second trehalose phosphorylase corresponding to amino acid position 318 of SEQ ID NO: 1 of the first trehalose phosphorylase;
- A, G, I, L, M, P, V, preferably I or V, and more preferably I for the amino acid position of the second trehalose phosphorylase corresponding to amino acid position 323 of SEQ ID NO: 1 of the first trehalose phosphorylase;
- A, G, I, L, M, P, V, preferably I for the amino acid position of the second trehalose phosphorylase corresponding to amino acid position 339 of SEQ ID NO: 1 of the first trehalose phosphorylase;
- W or Y, preferably Y for the amino acid position of the second trehalose phosphorylase corresponding to amino acid position 349 of SEQ ID NO: 1 of the first trehalose phosphorylase;
- A, I, L, M, P, V, preferably A for the amino acid position of the second trehalose phosphorylase corresponding to amino acid position 357 of SEQ ID NO: 1 of the first trehalose phosphorylase;
- N, C, Q, S, T, preferably S for the amino acid position of the second trehalose phosphorylase corresponding to amino acid position 459 of SEQ ID NO: 1 of the first trehalose phosphorylase;
- A, G, I, L, M, P, V, preferably G for the amino acid position of the second trehalose phosphorylase corresponding to amino acid position 476 of SEQ ID NO: 1 of the first trehalose phosphorylase;
- A, G, I, L, M, P, V, preferably I for the amino acid position of the second trehalose phosphorylase corresponding to amino acid position 481 of SEQ ID NO: 1 of the first trehalose phosphorylase;
- N, C, Q, S, T, preferably S for the amino acid position of the second trehalose phosphorylase corresponding to amino acid position 484 of SEQ ID NO: 1 of the first trehalose phosphorylase;
- A, G, I, L, M, P, V, preferably A, G, V or L, more preferably A, for the amino acid position of the second trehalose phosphorylase corresponding to amino acid position 487 of SEQ ID NO: 1 of the first trehalose phosphorylase;
- A, G, I, L, M, P, V, preferably A for the amino acid position of the second trehalose phosphorylase corresponding to amino acid position 488 of SEQ ID NO: 1 of the first trehalose phosphorylase;
- N, C, Q, S, T, preferably S for the amino acid position of the second trehalose phosphorylase corresponding to amino acid position 506 of SEQ ID NO: 1 of the first trehalose phosphorylase;
- N, C, Q, S, T, preferably S for the amino acid position of the second trehalose phosphorylase corresponding to amino acid position 511 of SEQ ID NO: 1 of the first trehalose phosphorylase;
- D or E, preferably E for the amino acid position of the second trehalose phosphorylase corresponding to amino acid position 526 of SEQ ID NO: 1 of the first trehalose phosphorylase;
- A, G, I, L, M, P, V, preferably V for the amino acid position of the second trehalose phosphorylase corresponding to amino acid position 530 of SEQ ID NO: 1 of the first trehalose phosphorylase;
- R, H, K, preferably R for the amino acid position of the second trehalose phosphorylase corresponding to amino acid position 532 of SEQ ID NO: 1 of the first trehalose phosphorylase;
- A, G, I, L, M, P, V, preferably G for the amino acid position of the second trehalose phosphorylase corresponding to amino acid position 533 of SEQ ID NO: 1 of the first trehalose phosphorylase;
- A, G, I, L, M, P, V, preferably M for the amino acid position of the second trehalose phosphorylase corresponding to amino acid position 537 of SEQ ID NO: 1 of the first trehalose phosphorylase;

A, G, I, L, M, P, preferably I or P, and more preferably I for the amino acid position of the second trehalose phosphorylase corresponding to amino acid position 550 of SEQ ID NO: 1 of the first trehalose phosphorylase;

N, C, Q, T, preferably T for the amino acid position of the second trehalose phosphorylase corresponding to amino acid position 556 of SEQ ID NO: 1 of the first trehalose phosphorylase;

D, E, preferably E for the amino acid position of the second trehalose phosphorylase corresponding to amino acid position 564 of SEQ ID NO: 1 of the first trehalose phosphorylase;

N, C, Q, S, T, A, G, I, L, M, P, V, preferably N, G or A, and more preferably N, for the amino acid position of the second trehalose phosphorylase corresponding to amino acid position 590 of SEQ ID NO: 1 of the first trehalose phosphorylase;

D, E, preferably E for the amino acid position of the second trehalose phosphorylase corresponding to amino acid position 649 of SEQ ID NO: 1 of the first trehalose phosphorylase;

D, E, R, H, K, preferably E or K, more preferably E, for the amino acid position of the second trehalose phosphorylase corresponding to amino acid position 667 of SEQ ID NO: 1 of the first trehalose phosphorylase;

D, E, preferably E for the amino acid position of the second trehalose phosphorylase corresponding to amino acid position 703 of SEQ ID NO: 1 of the first trehalose phosphorylase; and N, C, Q, S, T, preferably N for the amino acid position of the second trehalose phosphorylase corresponding to amino acid position 705 of SEQ ID NO: 1 of the first trehalose phosphorylase.

In an eleventh embodiment of the twelfth aspect which is also an embodiment of the first, second, third, fourth, fifth, sixth, seventh, eighth, ninth and tenth embodiment of the twelfth aspect, if the amino acid residue of the second trehalose phosphorylase corresponding to one or more amino acid positions of the amino acid sequence of the first trehalose phosphorylase, is the same as the substituted amino acid residue of the first trehalose phosphorylase, the amino acid residue of the second trehalose phosphorylase is not substituted.

In a twelfth embodiment of the twelfth aspect which is also an embodiment of the first, second, third, fourth, fifth, sixth, seventh, eighth, ninth, tenth and eleventh embodiment of the twelfth aspect, activity of trehalose phosphorylase is phosphorolysis activity and synthesis activity as defined in the description.

More specifically, these and other problems are solved in a 13$^{th}$ aspect, which is also the first embodiment of the 13$^{th}$ aspect, by a polypeptide having trehalose phosphorylase activity, wherein the polypeptide comprises an amino acid sequence, wherein the amino acid sequence is at least 20% homologous to the amino acid sequence of SEQ NO: 1, wherein the polypeptide comprises an amino acid substitution at two or more of amino acid positions selected from the group consisting of amino acid position 712, 383, 114, 118, 225, 304, 323, 349, 357, 487, 550, 556, 564, 590 and 649, wherein the amino acid substitution at amino acid position 712 is selected from the group consisting of the substitutions 712A, 712G, 712I, 712M, 712P or 712V, preferably 712M, the amino acid substitution at amino acid position 383 is selected from the group consisting of the substitutions 383A, 383G, 383I, 383L, 383M, 383V, 383N, 383C, 383Q, 383S or 383T, preferably 383A, 383G, 383M, 383V, 383N, 383C, 383Q, 383S or 383T, more preferably 383G, 383V, 383C, 383S or 383T, even more preferably 383V or 383T, and most preferably 383V, the amino acid substitution at amino acid position 114 is selected from the group consisting of the substitutions 114A, 114G, 114I, 114M, 114P or 114V, preferably 114I, the amino acid substitution at amino acid position 118 is 118A, 118G, 118I, 118L, 118M, 118P or 118V, preferably 118V, the amino acid substitution at amino acid position 225 is selected from the group consisting of the substitutions 225A, 225G, 225I, 225L, 225M, 225P or 225V, preferably 225I, 225L, 225M or 225V, and more preferably 225V, the amino acid substitution at amino acid position 304 is selected from the group consisting of the substitutions 304G, 304I, 304L, 304M, 304P or 304V, preferably 304I or 304L, and more preferably 304I, the amino acid substitution at amino acid position 323 is selected from the group consisting of the substitutions 323A, 323G, 323I, 323L, 323M, 323P, or 323V, preferably 323I or 323V, and more preferably 323I, the amino acid substitution at amino acid position 349 is selected from the group consisting of the substitutions 349W or 349Y, preferably 349Y, the amino acid substitution at amino acid position 357 is selected from the group consisting of the substitutions 357A, 357I, 357L, 357M, 357P or 357V, preferably 357A, the amino acid substitution at amino acid position 487 is selected from the group consisting of the substitutions 487A, 487G, 487I, 487L, 487M, 487P or 487V, preferably 487A, 487M, 487G, 487L or 487V, more preferably 487A, the amino acid substitution at amino acid position 550 is selected from the group consisting of the substitutions 550A, 550G, 550I, 550L, 550M or 550P, preferably 550 I or 550P, and more preferably 550I, the amino acid substitution at amino acid position 556 is selected from the group consisting of the substitutions 556N, 556C, 556Q or S556T, preferably 556T, the amino acid substitution at amino acid position 564 is selected from the group consisting of the substitutions 564D or 564E, preferably 564E, the amino acid substitution at amino acid position 590 is selected from the group consisting of the substitutions 590N, 590C, 590Q, 590S, 590T, 590A, 590G, 590I, 590L, 590M, 590P or 590V, preferably 590N, 590G or 590A, more preferably 590N, and the amino acid substitution at amino acid position 649 is selected from the group consisting of the substitutions 649D or 649E, preferably 649E;

wherein the amino acid numbering refers to an aligning position in SEQ ID NO: 1.

In a preferred embodiment of the 13$^{th}$ aspect of invention, which is also an embodiment of any other of the previous embodiments of the 13$^{th}$ aspect, the polypeptide is a polypeptide having trehalose phosphorylase activity, wherein the polypeptide comprises an amino acid sequence which is at least 77% homologous to the amino acid sequence of SEQ NO: 1, wherein the polypeptide comprises an amino acid substitution at two or more of amino acid positions selected from the group consisting of amino acid position 383, 114, 225, 304, 323, 349, 357, 550, 556, 564 and 649, wherein the amino acid substitution at amino acid position 383 is selected from the group consisting of the substitutions 383A, 383G, 383I, 383L, 383M, 383V, 383N, 383C, 383Q, 383S or 383T, preferably 383A, 383G, 383M, 383V, 383N, 383C, 383Q, 383S or 383T, more preferably 383G, 383V, 383C, 383S or 383T, even more preferably 383V or 383T, and most preferably 383V, the amino acid substitution at amino acid position 114 is selected from the group consisting of the substitutions 114A, 114G, 114I, 114M, 114P or 114V, preferably 114I, the amino acid substitution at amino acid position 225 is selected from the group consisting of the substitutions 225A, 225G, 225I, 225L, 225M, 225P or 225V, preferably 225I, 225L, 225M or 225V, and more preferably 225V, the amino acid substitution at amino acid position 304 is selected from the group consisting of the substitutions 304G, 304I, 304L, 304M, 304P or 304V, preferably 304I or 304L, and more preferably 304I, the amino acid substitution at amino acid position 323 is selected from the group consisting of the substitutions 323A, 323G, 323I, 323L, 323M, 323P, or 323V, preferably 323I or 323V, and more preferably 323I, the amino acid substitution at amino acid position 349 is selected from the group consisting of the substitutions 349W or 349Y, preferably 349Y, the amino acid substitution at amino acid position 357 is selected from the group consisting of the substitutions 357A, 357I, 357L, 357M, 357P or 357V, preferably 357A, the amino acid substitution at amino acid position 550 is selected from the group consisting of the substitutions 550A, 550G, 550I, 550L, 550M or 550P, preferably 550 I or 550P, and more preferably 550I, the amino acid substitution at amino acid position 556 is selected from the group consisting of the substitutions 556N, 556C, 556Q or S556T, preferably 556T, the amino acid substitution at amino acid position 564 is selected from the group consisting of the substitutions 564D or 564E, preferably 564E, and the amino acid substitution at amino acid position 649 is selected from the group consisting of the substitutions 649D or 649E, preferably 649E;

wherein the amino acid numbering refers to an aligning position in SEQ ID NO: 1.

In another preferred embodiment of the 13$^{th}$ aspect of the invention, which is also an embodiment of any other of the previous embodiments of the 13$^{th}$ aspect, the polypeptide comprises at least one further amino acid substitution at amino acid positions selected from amino acid position 712, 118, 487 and 590, wherein the amino acid substitution at amino acid position 712 is selected from the group consisting of the substitutions 712A, 712G, 712I, 712M, 712P or 712V, preferably 712M, the amino acid substitution at amino acid position 118 is selected from the group consisting of the substitutions 118A, 118G, 118I, 118L, 118M, 118P or 118V, preferably 118V, the amino acid substitution at amino acid position 487 is selected from the group consisting of the substitutions 487A, 487G, 487I, 487L, 487M, 487P or 487V, preferably 487A, 487G, 487L, 487M or 487V, more preferably 487A, and the amino acid substitution at amino acid position 590 is selected from the group consisting of the substitutions 590N, 590C, 590Q, 590S, 590T, 590A, 590G, 590I, 590L, 590M, 590P or 590V, preferably 590N, 590G or 590A, more preferably 590N;

wherein the amino acid numbering refers to an aligning position in SEQ ID NO: 1.

In another preferred embodiment of the 13$^{th}$ aspect of invention, which is also an embodiment of any other of the previous embodiments of the 13$^{th}$ aspect, the polypeptide is a polypeptide having trehalose phosphorylase activity, wherein the polypeptide comprises an amino acid sequence, wherein the amino acid sequence is at least 68% homologous to the amino acid sequence of SEQ NO: 1, wherein the polypeptide comprises an amino acid substitution at two or more of the amino acid positions each and individually selected from the group consisting of amino acid position 383, 114, 225, 304, 323, 349, 357, 550, 556 and 564, wherein the amino acid substitution at amino acid position 383 is selected from the group consisting of the substitutions 383A, 383G, 383I, 383L, 383M, 383V, 383N, 383C, 383Q, 383S or 383T, preferably 383A, 383G, 383M, 383V, 383N, 383C, 383Q, 383S or 383T, more preferably 383G, 383V, 383C, 383S or 383T, even more preferably 383V or 383T, and most preferably 383V, the amino acid substitution at amino acid position 114 is selected from the group consisting of the substitutions 114A, 114G, 114I, 114M, 114P or 114V, preferably 114I, the amino acid substitution at amino acid position 225 is selected from the group consisting of the substitutions 225A, 225G, 225I, 225L, 225M, 225P or 225V, preferably 225I, 225L, 225M or 225V, and more preferably 225V, the amino acid substitution at amino acid position 304 is 304I, the amino acid substitution at amino acid position 323 is selected from the group consisting of the substitutions 323A, 323G, 323I, 323L, 323M, 323P, or 323V, preferably 323I or 323V, and more preferably 323I, the amino acid substitution at amino acid position 349 is selected from the group consisting of the substitutions 349W or 349Y, preferably 349Y, the amino acid substitution at amino acid position 357 is selected from the group consisting of the substitutions 357A, 357I, 357L, 357M, 357P or 357V, preferably 357A, the amino acid substitution at amino acid position 550 is selected from the group consisting of the substitutions 550A, 550G, 550I, 550L, 550M or 550P, preferably 550 I or 550P, and more preferably 550I, the amino acid substitution at amino acid position 556 is selected from the group consisting of the substitutions 556N, 556C, 556Q or S556T, preferably 556T, and the amino acid substitution at amino acid position 564 is selected from the group consisting of the substitutions 564D or 564E, preferably 564E;

wherein the amino acid numbering refers to an aligning position in SEQ ID NO: 1.

In another preferred embodiment of the 13$^{th}$ aspect of invention, which is also an embodiment of any other of the previous embodiments of the 13$^{th}$ aspect, the polypeptide of the invention comprises at least one further amino acid substitution at at least one of the amino acid positions selected from group consisting of amino acid position 712, 118, 487, 590 and 649, wherein the amino acid substitution at amino acid position 712 is selected from the group consisting of the substitutions 712A, 712G, 712I, 712M, 712P or 712V, preferably 712M, the amino acid substitution at amino acid position 118 is selected from the group consisting of the substitutions 118A, 118G, 118I, 118L, 118M, 118P or 118V, preferably 118V, the amino acid substitution at amino acid position 487 is selected from the group consisting of the substitutions 487A, 487G, 487I, 487L, 487M, 487P or 487V, preferably 487A, 487G, 487L, 487M or 487V, more preferably 487A,
the amino acid substitution at amino acid position 590 is selected from the group consisting of the substitutions 590N, 590C, 590Q, 590S, 590T, 590A, 590G, 590I, 590L, 590M, 590P or 590V, preferably 590N, 590G or 590A, more preferably 590N, and
the amino acid substitution at amino acid position 649 is selected from the group consisting of the substitutions 649D or 649E, preferably 649E;
wherein the amino acid numbering refers to an aligning position in SEQ ID NO: 1.

In another preferred embodiment of the 13$^{th}$ aspect of invention, which is also an embodiment of any other of the previous embodiments of the 13$^{th}$ aspect, the polypeptide having trehalose phosphorylase activity is a polypeptide comprising an amino acid sequence, wherein the amino acid sequence is at least 63% homologous to the amino acid sequence of SEQ NO: 1, wherein the polypeptide comprises an amino acid substitution at two or more of amino acid positions selected from amino acid position 383, 114, 225, 304, 323, 349, 357, 556 and 564, wherein
the amino acid substitution at amino acid position 383 is selected from the group consisting of the substitutions 383A, 383G, 383I, 383L, 383M, 383V, 383N, 383C, 383Q, 383S or 383T, preferably 383A, 383G, 383M, 383V, 383N, 383C, 383Q, 383S or 383T, more preferably 383G, 383V, 383C, 383S or 383T, even more preferably 383V or 383T, and most preferably 383V,
the amino acid substitution at amino acid position 114 is selected from the group consisting of the substitutions 114A, 114G, 114I, 114M, 114P or 114V, preferably 114I,
the amino acid substitution at amino acid position 225 is selected from the group consisting of the substitutions 225A, 225G, 225I, 225L, 225M, 225P or 225V, preferably 225I, 225L, 225M or 225V, and more preferably 225V,
the amino acid substitution at amino acid position 304 is 304I,
the amino acid substitution at amino acid position 323 is selected from the group consisting of the substitutions 323A, 323G, 323I, 323L, 323M, 323P, or 323V, preferably 323I or 323V, and more preferably 323I,
the amino acid substitution at amino acid position 349 is selected from the group consisting of the substitutions 349W or 349Y, preferably 349Y,
the amino acid substitution at amino acid position 357 is selected from the group consisting of the substitutions 357A, 357I, 357L, 357M, 357P or 357V, preferably 357A, and
the amino acid substitution at amino acid position 556 is selected from the group consisting of the substitutions 556N, 556C, 556Q or S556T, preferably 556T,
the amino acid substitution at amino acid position 564 is selected from the group consisting of the substitutions 564D or 564E, preferably 564E;
wherein the amino acid numbering refers to an aligning position in SEQ ID NO: 1.

In another preferred embodiment of the 13$^{th}$ aspect of invention, which is also an embodiment of any other of the previous embodiments of the 13$^{th}$ aspect, the polypeptide of the invention comprises at least one further amino acid substitution at at least one amino acid positions selected from the group consisting of amino acid position 712, 118, 487, 550, 590 and 649, wherein
the amino acid substitution at amino acid position 712 is selected from the group consisting of the substitutions 712A, 712G, 712I, 712M, 712P or 712V, preferably 712M,
the amino acid substitution at amino acid position 118 is selected from the group consisting of the substitutions 118A, 118G, 118I, 118L, 118M, 118P or 118V, preferably 118V,
the amino acid substitution at amino acid position 487 is selected from the group consisting of the substitutions 487A, 487G, 487I, 487L, 487M, 487P or 487V, preferably 487A, 487G, 487L, 487M or 487V, more preferably 487A,
the amino acid substitution at amino acid position 550 is selected from the group consisting of the substitutions 550A, 550G, 550I, 550L, 550M or 550P, preferably 550 I or 550P, and more preferably 550I,
the amino acid substitution at amino acid position 590 is selected from the group consisting of the substitutions 590N, 590C, 590Q, 590S, 590T, 590A, 590G, 590I, 590L, 590M, 590P or 590V, preferably 590N, 590G or 590A, more preferably 590N, and
the amino acid substitution at amino acid position 649 is selected from the group consisting of the substitutions 649D or 649E, preferably 649E;
wherein the amino acid numbering refers to an aligning position in SEQ ID NO: 1

In a second embodiment of the 13$^{th}$ aspect, which is an embodiment of the first embodiment or of any other of the previous embodiments of the 13$^{th}$ aspect, the amino acid sequence is at least 50% homologous to the amino acid sequence of SEQ NO: 1.

In a third embodiment of the 13$^{th}$ aspect, which is an embodiment of the second embodiment or of any other of the previous embodiments of the 13$^{th}$ aspect, the amino acid sequence is at least 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79% or 80% homologous to the amino acid sequence of SEQ NO: 1.

In a fourth embodiment of the 13$^{th}$ aspect, which is also an embodiment of the first, second and third embodiment or of any other of the previous embodiments of the 13$^{th}$ aspect, the amino acid sequence comprises an amino acid substitution at two, three, four, five, six, seven, eight, nine, ten, eleven twelve, 13, 14, or 15 amino acid positions selected from amino acid position 712, 383, 114, 118, 225, 304, 323, 349, 357, 487, 550, 556, 564, 590 and 649.

In another preferred embodiment of the 13$^{th}$ aspect, which is also an embodiment of the first, second, third, and fourth embodiment or of any other of the previous embodiments of the 13$^{th}$ aspect, the polypeptide having trehalose phosphorylase activity is a wild type trehalose phosphorylase and/or a variant from a wild type trehalose phophorylase, which is derived from an organism belonging to the phylum of Basidomycota, preferably from an organism belonging to the class of Agaricomycetes, and more preferably from an organism belonging to a genus of the group consisting of the genera *Schizophyllum, Pleurotus, Grifola, Agaricus, Trametes, Coriolus, Trametes, Trichaptum,* and *Lenzites*. In another preferred embodiment of the 13$^{th}$ aspect, which is also an embodiment of the first, second, third, and fourth embodiment or of any other of the previous embodiments of the 13$^{th}$ aspect, the trehalose phosphorylase activity is determined as disclosed herein.

It will be understood that the trehalose phosphorylase described herein in its various aspects and embodiments may also be referred to as the trehalose phosphorylase of the present invention.

The present invention is based on the surprising finding that trehalose phosphorylase of EC number EC 2.4.1.231, which is also referred to as "TP", may be improved by enzyme engineering. As a starting point for such enzyme engineering trehalose phosphorylase having an amino acid sequence according to SEQ ID NO: 1 was used. Said trehalose phosphorylase having an amino acid sequence according to SEQ ID NO: 1 may be prepared from *Shizophyllum commune* which was characterized by Eis et al. (FEBS Letters 440, 440-443 (1998)). UniProt: D8PWQ7 (GenBank: EFJ00254.1) discloses the wild type protein sequence of an individual *Schizophyllum commune* isolate H4-8 (99.1% identity). The sequence deviates from SEQ ID NO: 1 in seven positions of SEQ ID NO: 1, wherein the isolate H4-8 carries a lysine amino acid residue in the position homologous to position 10 of SEQ ID NO: 1, a serine amino acid residue in the position homologous to position 32 of SEQ ID NO: 1, a valine amino acid residue in the position homologous to position 374 of SEQ ID NO: 1, a glutamic acid amino acid residue in the position homologous to position 535 of SEQ ID NO: 1, a proline amino acid residue in the position homologous to position 536 of SEQ ID NO: 1, an isoleucine amino acid residue in the position homologous to position 616 of SEQ ID NO:1 and a valine amino acid residue in the position homologous to position 649 of SEQ ID NO: 1. UniProt: AOA151VW19 (GenBank: KYQ39707.1) discloses the wild type protein sequence of a trehalose phosphorylase from the organism *Hypsizygus marmoreus*, which is to 77.9% identical to SEQ ID NO: 1. Besides *Schizophyllum commune* TP, other TPs from fungal origin have been described, e.g. *Lentinus sajor-caju* (73.2% homology), *Pleurotus ostreatus* (75.8% homology), or *Grifola frondosa* (76.7% homology). For *Grifola frondosa*, protein sequences derived from different isolates have been described, amongst them the sequences SEQ ID NO: 160 (UniProtKB/Swiss-Prot: Accession No: O75003.1) and SEQ ID NO: 81 (Genbank Accession No: ADM15725.1).

The present inventors have surprisingly found that replacing an amino acid residue at one or several of the following amino acid positions of the amino acid sequence of SEQ ID NO: 1 is suitable for improving the reaction characteristics of the trehalose phosphorylase of SEQ ID NO: 1: 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705. Among these amino acid positions of SEQ ID NO: 1 amino acid positions 712, 383, 10, 114, 118, 220, 225, 304, 318, 323, 349, 357, 481, 487, 488, 506, 511, 550, 556, 564, 590, 649, 703 and 705 are particularly suitable, with amino acid positions 712, 383, 114, 118, 225, 304, 323, 349, 357, 487, 550, 556, 564, 590 and 649, each of SEQ ID NO: 1 being even more suitable.

In accordance therewith, the present invention relates in a first aspect to a polypeptide comprising an amino acid sequence, wherein the amino acid sequence of the trehalose phosphorylase is at least 80% identical to and/or at least 80% homologous to an amino acid sequence of SEQ ID NO:1, wherein the amino acid sequence of the trehalose phosphorylase comprises an amino acid substitution at one or more amino acid positions, wherein the one or more amino acid positions is/are each and independently selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1.

In a preferred embodiment, the amino acid sequence of SEQ ID NO: 1 is the amino acid sequence of a polypeptide, whereby preferably the polypeptide is a trehalose phosphorylase.

In accordance therewith, the present invention equally relates in a first aspect to a trehalose phosphorylase comprising an amino acid sequence, wherein the amino acid sequence of the trehalose phosphorylase is at least 80% identical to and/or at least 80% homologous to an amino acid sequence of SEQ ID NO: 1, wherein the amino acid sequence of the trehalose phosphorylase comprises an amino acid substitution at one or more amino acid positions, wherein the one or more amino acid positions is/are selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1.

In an embodiment, the polypeptide of the first aspect is a trehalose phosphorylase, preferably a trehalose phosphorylase having one or several of the characteristics disclosed herein. In accordance therewith, the disclosure of the trehalose phosphorylase of the instant invention and in particular according to each and any aspect equally applies to the polypeptide of the instant invention, and vice versa. Furthermore, in an embodiment the polypeptide of the present invention is a polypeptide having trehalose phosphorylase activity. Preferably, trehalose activity is one which is defined herein.

The wording that a trehalose phosphorylase comprises an amino acid sequence, wherein the amino acid sequence of the trehalose phosphorylase is at least 80% identical to and/or at least 80% homologous to an amino acid sequence of SEQ ID NO: 1, wherein the amino acid sequence of the trehalose phosphorylase comprises an amino acid substitution at one or more amino acid positions, wherein the one or more amino acid positions is/are selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1, has, in an embodiment, the same meaning as the wording that a trehalose phosphorylase has at least 80% homology to SEQ ID NO: 1, wherein the trehalose phosphorylase comprises a substitution at one or more positions selected from 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705, where each position corresponds to a position of the amino acid sequence of SEQ ID NO: 1.

Insofar, the trehalose phosphorylase of the present invention, preferably including any aspect of the present invention, is a mutant trehalose phosphorylase and more specifically a mutant trehalose phosphorylase of a trehalose phosphorylase having an amino acid sequence of SEQ ID NO: 1. In an embodiment, the trehalose phosphorylase of the present invention is a trehalose phosphorylase having an amino acid sequence different from the amino acid sequence of SEQ ID NO: 1. In a further embodiment, the trehalose phosphorylase of the present invention is a trehalose phosphorylase which is different from a trehalose phosphorylase consisting of an amino acid sequence of SEQ ID NO: 1.

In accordance with the first aspect of the present invention the trehalose phosphorylase of the present invention comprises at least one amino acid substitution at at least one amino acid position of SEQ ID NO: 1. It is of note that, in principle, both the amino acid position where such substitution is made and the kind of substituted amino acid are of importance. In accordance therewith, in an embodiment of the trehalose phosphorylase of the present invention the amino acid substitution is made at one of the specific, indicated amino acid positions of SEQ ID NO: 1, whereby, optionally, the very amino acid residue present at such position of SEQ ID NO: 1 does not have any bearing on the kind of substituted amino acid residue present in the trehalose phosphorylase of the present invention; alternatively, and again optionally, the very amino acid residue present at such position of SEQ ID NO:1 has a bearing on the kind of substituted amino acid residue present in the trehalose phosphorylase of the present invention. The substitution may be non-conservative or conservative. For the purposes of the present invention, conservative means an exchange of the amino acid G to A; A to G, S; V to I, L, A, T, S; I to V, L, M; L to I, M, V; M to L, I, V; P to A, S, N; F to Y, W, H; Y to F, W, H; W to Y, F, H; R to K, E, D; K to R, E, D; H to Q, N, S; D to N, E, K, R, Q; E to Q, D, K, R, N; S to T, A; T to S, V, A; C to S, T, A; N to D, Q, H, S; Q to E, N, H, K, R.

Also in accordance therewith, in an embodiment of the trehalose phosphorylase of the present invention the amino acid substitution is one where the very amino acid residue of any of the indicated amino acid positions of SEQ ID NO: 1 is substituted, whereby, optionally, the amino acid position of the substituted amino acid residue is not exactly the one as indicated by reference to SEQ ID NO: 1; rather, in an embodiment, the amino acid position of the substituted amino acid residue differs from the corresponding position of SEQ ID NO: 1, preferably by one to five, preferably one to three, more preferably one to two and most preferably one amino acid position.

To the extent the trehalose phosphorylase of the present invention is characterized as comprising an amino acid substitution at one or more specified amino acid positions it will be understood that the trehalose phosphorylase of the present invention is one which has a single substitution at one of the indicated amino acid positions; it will, however, also be understood that the thus described trehalose phosphorylase of the present invention also encompasses those trehalose phosphorylases where more than one amino acid residue is substituted, such as two, three etc. amino acid residues. In the latter case, the number of amino acid residues which is substituted is any integer between one and the number of amino acid residues indicated and defined as being substituted. In accordance therewith, the trehalose phosphorylase of the present invention is any trehalose phosphorylase which has or realizes one amino acid substitution or any combination, actually each and any permutation, of the amino acid residues indicated and defined as being substituted.

In accordance therewith, the trehalose phosphorylase may comprise an amino acid substitution at one or any combination and, respectively, permutation of amino acid position of 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705. Accordingly, in an embodiment the trehalose phosphorylase of the present invention comprises at least an amino acid substitution at one of said amino acid positions of SEQ ID NO: 1, at least one amino acid substitution at at least two of said amino acid positions of SEQ ID NO: 1, at least one amino acid one amino acid substitution at at least three of said amino acid positions of SEQ ID NO: 1, at least one amino acid one amino acid substitution at at least four of said amino acid positions of SEQ ID NO: 1, at least one amino acid one amino acid substitution at at least five of said amino acid positions of SEQ ID NO: 1, at least one amino acid substitution at at least six of said amino acid positions of SEQ ID NO: 1, at least one amino acid substitution at at least seven of said amino acid positions of SEQ ID NO: 1, at least one amino acid substitution at at least eight of said amino acid positions of SEQ ID NO: 1, at least one amino acid substitution at at least nine of said amino acid positions of SEQ ID NO: 1, at least one amino acid substitution at at least ten of said amino acid positions of SEQ ID NO: 1, at least one amino acid substitution at at least eleven of said amino acid positions of SEQ ID NO: 1, at least one amino acid substitution at at least twelve of said amino acid positions of SEQ ID NO: 1, at least one amino acid substitution at at least thirteen of said amino acid positions of SEQ ID NO: 1, or at least one amino acid substitution at at least fourteen of said amino acid positions of SEQ ID NO: 1.

It is, however, also within the present invention that the trehalose phosphorylase of the present invention comprises even more than the above indicated substitutions at the indicated amino acid positions of SEQ ID NO: 1, preferably under the provision that the amino acid sequence of the trehalose phosphorylase meets at least one of the minimum structural feature and/or minimum functional features of the trehalose phosphorylase of the present invention. Such minimum structural feature is that the trehalose phosphorylase comprises an amino acid sequence, wherein the amino acid sequence of the trehalose phosphorylase is at least 80% identical to and/or at least 80% homologous to an amino acid sequence of SEQ ID NO: 1, wherein the amino acid sequence of the trehalose phosphorylase comprises an amino acid substitution at one or more amino acid positions, wherein the one or more amino acid positions is/are each and independently selected from the group consisting of amino acid positions of SEQ ID NO: 1 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705. Such minimum functional feature is one or any combination of any one of characteristics (A), (B), (C), (D) and (E) including any further specifications thereof disclosed herein, whereby characteristic (A) is thermal stability after incubation at 52° C. for 15 minutes defined by a residual activity of (i) at least 30% up to 90%; or (ii) at least 55% up to 100%, characteristic (B) is thermal stability after incubation at 52° C. for 15 minutes which is characterized by (i) a Tm30-value of at least 52° C. and/or a Tm50-value of at least 52° C., characteristic (C) is thermal stability characterized by a Tm30-value between 52° C. and 90° C. and/or a Tm50-value between 52° C. and 90° C., characteristic (D) is thermal stability characterized by (i) process stability characterized by a half-life at 45° C. of at least 3 hours up to 9 days, (ii) process stability characterized by a half-life at 45° C. of at least 24 hours up to 9 days and/or process stability characterized by a half-life at 45° C. of at least 4 days up to 9 days and characteristic (E) is relative activity expressed as 100/500-ratio of between at least 0.65 and 1.0, wherein the 100/500-ratio is defined as the ratio of [trehalose activity at 100 mM glucose and 100 mM alpha-glucose-1 phosphate]/[trehalose activity at 500 mM glucose and 100 mM alpha-glucose-1 phosphate]. It is within the present invention that the trehalose phosphorylase of the present invention displays characteristic (A), characteristic (B), characteristic (C), characteristic (D), characteristic (E), characteristics (A) and (B), characteristics (A) and (C), characteristics (A) and (D), characteristics (A) and (E), characteristics (B) and (C), characteristics (B) and (D), characteristics (B) and (E), characteristics (C) and (D), characteristics (C) and (E), characteristics (D) and (E), characteristics (A), (B) and (C), characteristics (A), (B) and (D), characteristics (A), (B) and (E), characteristics (B), (C) and (D), characteristics (B), (C) and (E), characteristics (C), (D) and (E), characteristics (A), (B), (C) and (D), characteristics (A), (B), (C) and (E), characteristics (B), (C), (D) and (E), characteristics (A), (C), (D) and (E), or characteristics (A), (B), (C), (D) and (E).

In an embodiment of the trehalose phosphorylase of the present invention, the amino acid sequence of the trehalose phosphorylase comprises an amino acid substitution at at least two amino acid positions of the amino acid sequence of SEQ ID NO: 1. These at least two amino acid positions are also referred to herein as a pair of two amino acid positions. In an embodiment of the trehalose phosphorylase of the present invention the pair of two amino acid positions is selected from the group consisting of V10 and L114, V10 and I118, V10 and Y220, V10 and N225, V10 and A304, V10 and T323, V10 and F349, V10 and G357, V10 and P383, V10 and Q487, V10 and A506, V10 and V550, V10 and S556, V10 and T564, V10 and D590, V10 and A649, V10 and K705, V10 and L712, L114 and I118, L114 and Y220, L114 and N225, L114 and A304, L114 and T323, V10 and F349, L114 and G357, L114 and P383, L114 and Q487, L114 and A506, L114 and V550, L114 and S556, L114 and T564, L114 and D590, L114 and A649, L114 and K705, L114 and L712, I118 an Y220, I118 and N225, I118 and A304, I118 and T323, V10 and F349, I118 and G357, I118 and P383, I118 and Q487, I118 and A506, I118 and V550, I118 and S556, I118 and T564, I118 and D590, I18 and A649, L118 and K705, I118 and L712, Y220 and N225, Y220 and A304, Y220 and T323, V10 and F349, Y220 and G357, Y220 and P383, Y220 and Q487, Y220 and A506, Y220 and V550, Y220 and S556, Y220 and T564, Y220 and D590, Y220 and A649, Y220 and K705, Y220 and L712, N225 and A304, N225 and T323, V10 and F349, N225 and G357, N225 and P383, N225 and Q487, N225 and A506, N225 and V550, N225 and S556, N225 and T564, N225 and D590, N225 and A649, N225 and K705, N225 and L712, A304 and T323, V10 and F349, A304 and G357, A304 and P383, A304 and Q487, A304 and A506, A304 and V550, A304 and S556, A304 and T564, A304 and D590, A304 and A649, A304 and K705, A304 and L712, T323 and F349, T323 and G357, T323 and P383, T323 and Q487, T323 and A506, T323 and V550, T323 and S556, T323 and T564, T323 and D590, T323 and A649, T323 and K705, T323 and L712, F349 and G357, F349 and P383, F349 and Q487, F349 and A506, F349 and V550, F349 and S556, F349 and T564, F349 and D590, F349 and A649, F349 and K705, F349 and L712, G357 and P383, G357 and Q487, G357 and A506, G357 and V550, G357 and S556, G357 and T564, G357 and D590, G357 and A649, G357 and K705, G357 and L712, P383 and Q487, P383 and A506, P383 and V550, P383 and S556, P383 and T564, P383 and D590, P383 and A649, P383 and K705, P383 and L712, Q487 and A506, Q487 and V550, Q487 and S556, Q487 and T564, Q487 and D590, Q487 and A649, Q487 and K705, Q487 and L712, A506 and V550, A506 and S556, A506 and T564, A506 and D590, A506 and A649, A506 and K705, A506 and L712, V550 and S556, V550 and T564, V550 and D590, V550 and A649, V550 and K705, V550 and L712, S556 and T564, S556 and D590, S556 and A649, S556 and K705, S556 and L712, T564 and D590, T564 and A649, T564 and K705, T564 and L712, D590 and A649, D590 and K705, D590 and L712, A649 and L712, A649 and K705, and K705 and L712. Further embodiments of the trehalose phosphorylase of the present invention are those where the pair of two amino acid positions is selected from a more limited group, including those more limited groups of pairs of two amino acid positions specifically disclosed herein. It is within the present invention that a trehalose phosphorylase comprises an amino acid substitution at one of these pairs of two amino acid positions of SEQ ID NO: 1.

As disclosed herein, in a further embodiment the trehalose phosphorylase comprises in addition to amino acid substitution at the pair of two amino acid positions of SEQ ID NO: 1 an amino acid substitution at at least one or more additional amino acid positions of SEQ ID NO: 1. Such one or more additional amino acid positions of SEQ ID NO: 1 are individually and independently selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705, each of SEQ ID NO: 1. Further embodiments of the trehalose phosphorylase of the present invention are those where the one or more additional amino acid position is selected from a more limited group, including those more limited groups of additional amino acid positions specifically disclosed herein. It is within the present invention that a trehalose phosphorylase comprises an amino acid substitution at one of these pairs of two amino acid positions of SEQ ID NO: 1 and at one of said additional amino acid sequences. In accordance therewith, the trehalose phosphorylase of the present invention is, each in an embodiment, a trehalose phosphorylase having an amino acid substitution at at least three amino acid positions, namely at the pair of two amino acid position and at one of said additional amino acid positions of SEQ ID NO: 1, a trehalose phosphorylase having an amino acid substitution at at least four amino acid positions, namely at the pair of two amino acid position and at two of said additional amino acid positions of SEQ ID NO: 1, a trehalose phosphorylase having an amino acid substitution at at least five amino acid positions, namely at the pair of two amino acid position and at three of said additional amino acid positions of SEQ ID NO: 1, or a trehalose phosphorylase having an amino acid substitution at at least six amino acid positions, namely at the pair of two amino acid position and at four of said additional amino acid positions of SEQ ID NO: 1. An embodiment of the trehalose phosphorylase of the present invention wherein the trehalose phosphorylase comprises an amino acid substitution at at least four amino acid positions, is a trehalose phosphorylase comprising an amino acid substitution at amino acid positions 712, 383, 114 and 118, each of SEQ ID NO: 1. An embodiment of the trehalose phosphorylase of the present invention wherein the trehalose phosphorylase comprises an amino acid substitution at at least five amino acid positions, is a trehalose phosphorylase comprising an amino acid substitution at amino acid positions 712, 383, 114, 118 and 304, each of SEQ ID NO: 1, and/or at amino acid positions 712, 383, 114, 118 and 357, each of SEQ ID NO: 1. An embodiment of the trehalose phosphorylase of the present invention wherein the trehalose phosphorylase comprises an amino acid substitution at at least six amino acid positions, is a trehalose phosphorylase comprising an amino acid substitution at amino acid positions 712, 383, 114, 118, 304 and 357, each of SEQ ID NO: 1.

In a further embodiment, the trehalose phosphorylase comprises in addition to the amino acid substitution at the pair of two amino acid positions of SEQ ID NO:1 and the amino acid substitution at at least one more additional amino acid positions of SEQ ID NO: 1, with the one or more additional amino acid position of SEQ ID NO: 1 being preferably one, two, three or four amino acid positions of SEQ ID NO: 1 as disclosed herein, an amino acid substitution at one or more still further amino acid positions of SEQ ID NO: 1. Such one or more still further amino acid positions of SEQ ID NO: 1 are individually and independently selected from the group consisting of amino acid positions 10, 192, 197, 220, 225, 306, 318, 323, 339, 349, 459, 476, 481, 484, 487, 488, 506, 511, 526, 530, 532, 533, 537, 550, 556, 564, 649, 667, 703 and 705, each of SEQ ID NO: 1. Further embodiments of the trehalose phosphorylase of the present invention are those where the one or more still further amino acid position is selected from a more limited group, including those more limited groups of additional amino acid positions specifically disclosed herein.

As to specific substitutions disclosed herein it is to be noted that in accordance with common practice in the field of amino acid substitutions the substitution refers to the number of the amino acid position where a substitution is made, with the left number being flanked on both sides by the indication of an amino acid residue with the amino acid residue on the left side being the amino acid residue as present in the non-substituted amino acid sequence and the amino acid residue on the right side being the amino acid residue as present in the substituted amino acid sequence. Accordingly and for illustrative purposes only, substitution V10R indicated that at amino acid position 10 the valine reside is replaced by arginine.

It is within the present invention that any of the mutations at an amino acid positions of SEQ ID NO: 1 as disclosed herein is one which results, either alone or in any combination, in a protein which is still active as a trehalose phosphorylase, more specifically as a trehalose phosphorylase in accordance with EC 2.4.1.213. Preferably, any of said mutations results, either alone or in any combination, in a trehalose phosphorylase of EC number EC 2.4.1.213 having at least one of characteristics (A), (B), (C), (D) and (E), or any combination of such characteristics, as disclosed herein.

It will be understood that in connection with the trehalose phosphorylase of the present invention apart from the substitutions specifically discloses herein, preferably the substitutions at the amino acid positions of SEQ ID NO:1 disclosed herein, further and/or different substitution may be made. Preferably, such further substitutions are made at positions different from amino acid positions D379, H403, R507 and K512, each of SEQ ID NO: 1, which positions are described to be essential for proper reaction catalysis.

It is known how the identity and homology, respectively, of a polymer of amino acid residues is determined. Homology is preferably calculated as identity using BLASTP (see, for example, Stephen F. Altschul, Thomas L. Madden, Alejandro A. Schiffer, Jinghui Zhang, Zheng Zhang, Webb Miller, and David J. Lipman (1997) "Gapped BLAST and PSI-BLAST: a new generation of protein database search programs", Nucleic Acids Res. 25:3389-3402; or Stephen F. Altschul, John C. Wootton, E. Michael Gertz, Richa Agarwala, Aleksandr Morgulis, Alejandro A. Schiffer, and Yi-Kuo Yu (2005) "Protein database searches using compositionally adjusted substitution matrices." FEBS J. 272:5101-5109).

In an embodiment, the trehalose of the present invention is a phosphorylase classified as EC 2.4.1.231 which catalyzes phosphorolytic cleavage of trehalose with net retention of the anomeric configuration using inorganic phosphate as glucosyl acceptor into glucose and alpha-D-glucose-1 phosphate (aG1P). Such reaction is reversible and, accordingly, the trehalose phosphorylase of the present invention converts glucose and alpha-D-glucose-1 phosphate (aG1P) into trehalose and inorganic phosphate. Trehalose is the disaccharide alpha-d-glucopyranosyl alpha-d-glucopyranoside (alpha,alpha-trehalose), characterized as the molecular entity with the molecular structure as defined by IUPAC as (2R,3S,4S,5R,6R)-2-(Hydroxymethyl)-6-[(2R,3R,4S,5S,6R)-3,4,5-trihydroxy-6-(hydroxymethyl)oxan-2-yl]oxyoxane-3,4,5-triol in any physical form.

In a further embodiment, based on amino acid sequence similarity, the trehalose phosphorylase of the present invention is classified as a member of the glycosyltransferase family GT4 in the Carbohydrate-Active Enzymes database (CAZy, Lombard et al (2014) Nucleic Acids Res 42: D490-D495.

In an embodiment, the trehalose phosphorylase of the present invention reacts a glucosyl monosaccharide and alpha-D-glucose-1 phosphate. In a preferred embodiment, the glucosyl monosaccharide is glucose, whereby the reaction product is preferably trehalose.

In a further embodiment, trehalose phosphorylase of the present invention reacts monosaccharides different from glucose. Such monosaccharides different from glucose are preferably selected from the group comprising D-mannose, 2-deoxy D-glucose, 2-fluoro D-glucose 2-deoxy-2-fluoro-D-glucose, 5-thio-D-glucose and 2-keto-D-glucose, which are described as suitable monosaccharides for phosphorylase classified as EP 2.4.1.231 see, for example, (Schwarz et al. J Biotechnol 129, 140-150 (2007), Nidetzky 2001 et al Biochem J (2001) 360, 727-736)).

In a still further embodiment, the trehalose phosphorylase of the present invention does not react beta-D glucose 1-phosphate, alpha-D-galactose 1-phosphate, alpha-D-mannose 1-phosphate, or alpha-D-xylose 1-phosphate as alternative glycosyl donors instead of aG1P (Schwarz et al. J Biotechnol 129, 140-150 (2007), Saito et al Appl Microbiol Biotechnol 64: 4340-4345 (1998)).

In accordance with another embodiment, the trehalose phosphorylase of the present invention preferably being a phosphorylase classified as EC 2.4.1.231, does not phosphorolytically cleave other disaccharides such as alpha,beta-trehalose, beta,beta-trehalose, sucrose, cellobiose, lactose, maltose, isomaltulose, isomaltose, lactulose or melibiose (see, for example, Schwarz et al. J Biotechnol 129, 140-150 (2007), Eis et al FEBS Letters 440 (1998) 440-443, Saito et al Appl Microbiol Biotechnol 64: 4340-4345 (1998)).

In a second aspect, the present invention is related to a polypeptide having certain functional characteristics. Preferably, the polypeptide is a polypeptide having trehalose phosphorylase activity. More preferably, the polypeptide is a trehalose phosphorylase.

In a preferred embodiment of the second aspect, which is also an embodiment of any previous embodiment of the second aspect, and which is also an additional aspect of the invention, the polypeptide comprises an amino acid sequence, wherein the amino acid sequence of the polypeptide, preferably of the trehalose phosphorylase, is at least 80% identical to and/or at least 80% homologous to an amino acid sequence of SEQ ID NO: 1, wherein the polypeptide, preferably trehalose phosphorylase, has at least one of characteristics (A), (B), (C), (D) and (E), or any combination thereof, with characteristic (A) being thermal stability after incubation at 52° C. for 15 minutes defined by a residual activity, characteristic (B) being thermal stability after incubation at 52° C. for 15 minutes, whereby such thermal stability is defined by a minimum Tm30 value and/or a minimum Tm50 value, whereby the Tm30 value and the Tm50 value are as defined herein, characteristic (C) being thermal stability defined by a Tm30 value and/or a Tm50 value between a certain temperature range, characteristic (D) being thermal stability, wherein thermal stability is defined by process stability with process stability being defined as half-life, preferably half-life of trehalose phosphorylase activity at 45° C. for a certain period of time, and characteristic (E) is relative activity expressed as 100/500 ratio.

In another preferred embodiment of the second aspect, which is also an embodiment of any previous embodiment of the second aspect, and which is also an additional aspect of the invention, the invention is related to a thermally stable trehalose phosphorylase variant wherein the variant retains at least 30% of its initial activity after incubation for 15 minutes at 52° C. in a buffer containing 1 M sucrose, and the initial activity is determined after incubation for 15 minutes at room temperature. Preferably such trehalose variant is a thermally stable trehalose phosphorylase variant, more preferably a trehalose phosphorylase according to the first aspect of the present invention.

In another preferred embodiment of the second aspect, which is also an embodiment of any previous embodiment of the second aspect, and which is also an additional aspect of the invention, the present invention is related to a thermally stable variant of trehalose phosphorylase from *Schizophyllum commune*, wherein the variant has a residual activity of at least 30% after incubation at 52° C. for 15 minutes. Preferably such trehalose variant is a thermally stable trehalose phosphorylase variant, more preferably a trehalose phosphorylase according to the first aspect of the present invention.

In another preferred embodiment of the second aspect, which is also an embodiment of any previous embodiment of the second aspect, and which is also an additional aspect of the invention, the present invention is related to a variant of a trehalose phosphorylase comprising an amino acid sequence of SEQ ID NO: 1, wherein the variant has a residual activity of at least 30% after incubation at 52° C. for 15 minutes. Preferably such trehalose variant is a thermally stable trehalose phosphorylase variant, more preferably a trehalose phosphorylase according to the first aspect of the present invention.

In another preferred embodiment of the second aspect, which is also an embodiment of any previous embodiment of the second aspect, and which is also an additional aspect of the invention, the present invention is related to a thermally stable variant of trehalose phosphorylase from *Grifola frondosa*, wherein the variant has a residual activity of at least 30% after incubation at 52° C. for 15 minutes. Preferably such trehalose variant is a thermally stable trehalose phosphorylase variant, more preferably a trehalose phosphorylase according to the 14$^{th}$ aspect of the present invention.

In another preferred embodiment of the second aspect, which is also an embodiment of any previous embodiment of the second aspect, and which is also an additional aspect of the invention, the present invention is related to a polypeptide, preferably of the trehalose phosphorylase, which is an enzymatically active fragment of the polypeptide, preferably of the trehalose phosphorylase, as defined in any aspect or in any of the preferred embodiments of an aspect described herein, more preferably a trehalose phosphorylase according to the first, third, fourth, fifth, or 14$^{th}$ aspect of the present invention.

In another preferred embodiment of the second aspect, which is also an embodiment of any previous embodiment of the second aspect, and which is also an additional aspect of the invention the present invention is related to polypeptide having trehalose phosphorylase activity, wherein the polypeptide comprises an amino acid sequence, wherein the amino acid sequence is at least 20% homologous to the amino acid sequence of SEQ NO:1, wherein the polypeptide comprises two or more of the following amino acid positions selected from 712A, 712G, 712I, 712M, 712P or 712V, preferably 712M, 383A, 383G, 383I, 383L, 383M, 383V, 383N, 383C, 383Q, 383S or 383T, preferably 383V or 383S, most preferably 383V, 114A, 114G, 114I, 114M, 114P or 114V, preferably 114I, 118A, 118G, 118I, 118L, 118M, 118P or 118V, preferably 118V, 225A, 225G, 225I, 225L, 225M, 225P or 225V, preferably 225V, 304G, 304I, 304L, 304M, 304P or 304V, preferably 304I, 323A, 323G, 323I, 323L, 323M, 323P, or 323V, preferably 323I, 349W or 349Y, preferably 349Y, 357A, 357I, 357L, 357M, 357P or 357V, preferably 357A, 487A, 487G, 487I, 487L, 487M, 487P or 487V, preferably 487A, 487G, 487L or 487V, more preferably 487A, 550A, 550G, 550I, 550L, 550M or 550P, preferably 550I, 556N, 556C, 556Q or S556T, preferably 556T, 564D or 564E, preferably 564E, 590N, 590C, 590Q, 590S, 590T, 590A, 590G, 590I, 590L, 590M, 590P or 590V, preferably 590N or 590A, more preferably 590N, and 649D or 649E, preferably 649E with the numbering referring to an aligning position in SEQ ID NO: 1.

It will be understood by a person skilled in the art how to identify amino acids positions of any wild type sequence of a trehalose phosphorylase enzyme that is corresponding to the abovementioned positions in SEQ ID NO: 1. For clarification, and without limiting the disclosure of this invention, FIG. 3 shows a complete alignment of SEQ ID NO:1 to several wild-type trehalose phosphorylase enzymes known in the state of the art. In addition, Table 5 shows the numbering and amino acid in sequence positions of further wild types trehalose phosphorylase enzymes, which correspond to the positions 114, 118, 225, 304, 323, 349, 383, 487, 550, 556, 564, 590, 649, and 712 of SEQ ID NO:1.

In another preferred embodiment which is also an embodiment of any previous embodiment of the second aspect, the present invention relates to the polypeptides $A_1$-$A_{10}$ to $N_1$-$N_{10}$ in accordance with the following table (with columns representing the number of positions and rows representing the percent homology), wherein the polypeptides having trehalose phosphorylase activity according to the present invention with different homologies to SEQ ID NO:1 comprise a combination of a different number of amino acid positions selected from 712A, 712G, 712I, 712M, 712P or 712V, preferably 712M, 383A, 383G, 383I, 383L, 383M, 383V, 383N, 383C, 383Q, 383S or 383T, preferably 383V or 383S, most preferably 383V, 114A, 114G, 114I, 114M, 114P or 114V, preferably 114I, 118A, 118G, 118I, 118L, 118M, 118P or 118V, preferably 118V, 225A, 225G, 225I, 225L, 225M, 225P or 225V, preferably 225V, 304G, 304I, 304L, 304M, 304P or 304V, preferably 304I, 323A, 323G, 323I, 323L, 323M, 323P, or 323V, preferably 323I, 349W or 349Y, preferably 349Y, 357A, 357I, 357L, 357M, 357P or 357V, preferably 357A, 487A, 487G, 487I, 487L, 487M, 487P or 487V, preferably 487A, 487G, 487L or 487V, more preferably 487A, 550A, 550G, 550I, 550L, 550M or 550P, preferably 550I, 556N, 556C, 556Q or S556T, preferably 556T, 564D or 564E, preferably 564E, 590N, 590C, 590Q, 590S, 590T, 590A, 590G, 590I, 590L, 590M, 590P or 590V, preferably 590N or 590A, more preferably 590N, and 649D or 649E, preferably 649E with the numbering referring to the aligning position in SEQ ID NO:1. The combination of positions 712M/118V for example describes a polypeptide that has a methionine in the position that aligns to position 712 of SEQ ID NO:1 and a valine in the position that aligns to position 118 of SEQ ID NO:1.

TABLE 1

| No | Homology to SEQ ID NO: 1 | Number of combined substitution positions |||||||||||||| 
| | | A | B | C | D | E | F | G | H | I | J | K | L | M | N |
|---|---|---|---|---|---|---|---|---|---|---|---|---|---|---|---|
| 1 | ≥20% < 30% | 2 | 3 | 4 | 5 | 6 | 7 | 8 | 9 | 10 | 11 | 12 | 13 | 14 | 15 |
| 2 | ≥30% < 40% | 2 | 3 | 4 | 5 | 6 | 7 | 8 | 9 | 10 | 11 | 12 | 13 | 14 | 15 |
| 3 | ≥40% < 50% | 2 | 3 | 4 | 5 | 6 | 7 | 8 | 9 | 10 | 11 | 12 | 13 | 14 | 15 |
| 4 | ≥50% < 55% | 2 | 3 | 4 | 5 | 6 | 7 | 8 | 9 | 10 | 11 | 12 | 13 | 14 | 15 |
| 5 | ≥55% < 60% | 2 | 3 | 4 | 5 | 6 | 7 | 8 | 9 | 10 | 11 | 12 | 13 | 14 | 15 |
| 6 | ≥60% < 65% | 2 | 3 | 4 | 5 | 6 | 7 | 8 | 9 | 10 | 11 | 12 | 13 | 14 | 15 |
| 7 | ≥65% < 70% | 2 | 3 | 4 | 5 | 6 | 7 | 8 | 9 | 10 | 11 | 12 | 13 | 14 | 15 |
| 8 | ≥70% < 75% | 2 | 3 | 4 | 5 | 6 | 7 | 8 | 9 | 10 | 11 | 12 | 13 | 14 | 15 |
| 9 | ≥75% < 80% | 2 | 3 | 4 | 5 | 6 | 7 | 8 | 9 | 10 | 11 | 12 | 13 | 14 | 15 |
| 10 | ≥80% | 2 | 3 | 4 | 5 | 6 | 7 | 8 | 9 | 10 | 11 | 12 | 13 | 14 | 15 |

For example, $D_4$ means that the polypeptide has a homology of at least 50% to SEQ ID NO:1 and comprises substitutions at 5 positions selected from 712A, 712G, 712I, 712M, 712P or 712V, preferably 712M, 383A, 383G, 383I, 383L, 383M, 383V, 383N, 383C, 383Q, 383S or 383T, preferably 383V or 383S, most preferably 383V, 114A, 114G, 114I, 114M, 114P or 114V, preferably 114I, 118A, 118G, 118I, 118L, 118M, 118P or 118V, preferably 118V, 225A, 225G, 225I, 225L, 225M, 225P or 225V, preferably 225V, 304G, 304I, 304L, 304M, 304P or 304V, preferably 304I, 323A, 323G, 323I, 323L, 323M, 323P, or 323V, preferably 323I, 349W or 349Y, preferably 349Y, 357A, 357I, 357L, 357M, 357P or 357V, preferably 357A, 487A, 487G, 487I, 487L, 487M, 487P or 487V, preferably 487A, 487G, 487L or 487V, more preferably 487A, 550A, 550G, 550I, 550L, 550M or 550P, preferably 550I, 556N, 556C, 556Q or S556T, preferably 556T, 564D or 564E, preferably 564E, 590N, 590C, 590Q, 590S, 590T, 590A, 590G, 590I, 590L, 590M, 590P or 590V, preferably 590N or 590A, more preferably 590N, and 649D or 649E, preferably 649E.

In another preferred embodiment, which is also an embodiment of any previous embodiment of the second aspect, the present invention is related to polypeptide having trehalose phosphorylase activity, wherein the polypeptide comprises an amino acid sequence, wherein the amino acid sequence is at least 77% homologous to the amino acid sequence of SEQ NO:1, wherein the polypeptide comprises two or more of amino acid positions selected from amino acid position 383, 114, 225, 304, 323, 349, 357, 550, 556, 564 and 649, wherein the amino acid numbering refers to an aligning position in SEQ ID NO: 1.

In another preferred embodiment, which is also an embodiment of any previous embodiment of the second aspect, the present invention is related to polypeptide having trehalose phosphorylase activity, wherein the polypeptide comprises an amino acid sequence, wherein the amino acid sequence is at least 68% homologous to the amino acid sequence of SEQ NO:1, wherein the polypeptide comprises an amino acid substitution at two or more of amino acid positions selected from amino acid position 383, 114, 225, 304, 323, 349, 357, 550, 556 and 564, wherein the amino acid numbering refers to an aligning position in SEQ ID NO: 1.

In another preferred embodiment, which is also an embodiment of any previous embodiment of the second aspect, the present invention is related to polypeptide having trehalose phosphorylase activity, wherein the polypeptide comprises an amino acid sequence, wherein the amino acid sequence is at least 63% homologous to the amino acid sequence of SEQ NO:1, wherein the polypeptide comprises an amino acid substitution at two or more of amino acid positions selected from amino acid position 383, 114, 225, 304, 323, 349, 357, 556 and 564, wherein the amino acid numbering refers to an aligning position in SEQ ID NO: 1.

In another preferred embodiment, which is also an embodiment of any previous embodiment of the second aspect, the present invention is related to polypeptide having trehalose phosphorylase activity, wherein the amino acid sequence is at least 50% homologous to the amino acid sequence of SEQ NO:1.

In another preferred embodiment, the present invention is related to polypeptide having trehalose phosphorylase activity, wherein amino acid sequence is at least 51%, 52%, 53%, 54%, 55%, 56%, 57%, 58%, 59%, 60%, 61%, 62%, 63%, 64%, 65%, 66%, 67%, 68%, 69%, 70%, 71%, 72%, 73%, 74%, 75%, 76%, 77%, 78%, 79% or 80%, homologous to the amino acid sequence of SEQ NO:1.

It will also be appreciated that the polypeptide and preferably the trehalose phosphorylase of the first aspect and any of its embodiments may be an embodiment of the second aspect and any of its embodiments. It will also be appreciated that the polypeptide and preferably the trehalose phosphorylase of the second aspect and any of its embodiments may be an embodiment of the first aspect and any of its embodiments.

In a sixth aspect, the present invention is related to a method for reacting a glucosyl monosaccharide and alpha-D-glucose-1 phosphate wherein the method comprises reacting the glucosyl monosaccharide and alpha-D-glucose-1 phosphate with a trehalose phosphorylase of the present invention, preferably a trehalose phosphorylase according to the first and/or second aspect.

In a seventh aspect, the present invention is related to a method for converting glucose and alpha-D-glucose-1 phosphate into trehalose and inorganic phosphate, wherein the method comprises reacting glucose and alpha-D-glucose-1 phosphate to trehalose and inorganic phosphate with a trehalose phosphorylase of the present invention, preferably a trehalose phosphorylase according to the first and/or second aspect.

In an eighth aspect, the present invention is related to a method for converting trehalose and inorganic phosphate into glucose and alpha-D-glucose-1 phosphate, and wherein the method comprises reacting trehalose and inorganic phosphate to glucose and alpha-D-glucose-1 phosphate with a trehalose phosphorylase of the present invention, preferably a trehalose phosphorylase according to the first and/or second aspect.

In a ninth aspect, the present invention is related to the use of a trehalose phosphorylase according to the first and/or second aspect for producing trehalose.

In a tenth aspect, the present invention is related to a method for preparing trehalose comprising reacting glucose and alpha-D-glucose-1 phosphate at a temperature of at least 40° C. in the presence of a trehalose phosphorylase, wherein the trehalose phosphorylase
  (i) retains at least 50% of its activity after incubation for 15 minutes at 52° C. in a buffer containing 1 M sucrose compared to its activity without thermal treatment, and/or (ii) has a ratio of activity at 100 mM glucose to catalytic activity at 500 mM glucose of at least 0.65.

In an embodiment, the trehalose phosphorylase is a trehalose phosphorylase according to the first and/or second aspect.

In an eleventh aspect, the present invention is related to a method for increasing thermal stability of a trehalose phosphorylase, wherein the method comprises:
  aligning an amino acid sequence of a first trehalose phosphorylase with an amino acid sequence of a second trehalose phosphorylase,
  identifying one or more amino acid positions of the amino acid sequence of the second trehalose phosphorylase which correspond to one or more amino acid positions of the amino acid sequence of the first trehalose phosphorylase, wherein substitution of an amino acid residue at the one or more amino acid position of the amino acid sequence of the first trehalose phosphorylase increases thermal stability of the first trehalose phosphorylase,
  substituting an amino acid residue at the one or more amino acid positions of the second trehalose phosphorylase corresponding to the one or more amino acid positions of the amino acid sequence of the first trehalose phosphorylase, wherein substitution of an amino acid residue at the one or more amino acid position of the amino acid sequence of the first trehalose phosphorylase increases thermal stability of the first trehalose phosphorylase;
  wherein the first trehalose phosphorylase is a trehalose phosphorylase comprising an amino acid sequence according to SEQ ID NO: 1.

It is within the present invention that the trehalose phosphorylase of the invention is present as full-length enzyme. It is also within the present invention that the trehalose phosphorylase of the invention is present as a fragment. Preferably, the fragment retains trehalose phosphorylase activity, preferably a trehalose phosphorylase activity as defined and, respectively disclosed herein for the trehalose phosphorylase of the invention.

In a further aspect, the present invention is related to a nucleic acid molecule encoding the trehalose phosphorylase of the present invention. It is generally known to derive such nucleic acid molecule based on the amino acid sequence discloses herein. Preferably, the nucleic acid sequence depends on the expression system used for the expression of the trehalose phosphorylase of the present invention. Preferred expression systems used for the expression of trehalose phosphorylase of the invention are *E. coli, Bacillus* sp, *P. pastoris* and fungal expression systems like *Aspergillus* sp.

In a still further aspect, the present invention is related to a vector containing the nucleic acid molecule encoding the trehalose phosphorylase of the present invention. Preferably, the vector is an expression vector. Suitable vectors for the expression of enzymes have been described in the state of the art.

In a further aspect, the present invention is related to a host organism containing the vector of the invention. Suitable hosts for hosts containing vectors for the expression of enzymes have been described, and preferably, the host organism is are *E. coli, Bacillus* sp, *P. pastoris* or a fungal expression system like *Aspergillus* sp., preferably *E. coli* and *P. pastoris*. Also known are methods to incorporate such vector into the host organism.

In another aspect, the present invention is related a method for the expression of a trehalose phosphorylase. Such method comprises cultivating a host organism disclosed in the description, wherein the host organism comprises an expression vector, wherein the expression vector comprises a nucleic acid molecule encoding a trehalose phosphorylase according to the present invention, under conditions which allow expression of said nucleic acid molecule, and harvesting the trehalose phosphorylase.

In an embodiment of each and any aspect of the invention, including any embodiment thereof, the Tm30-value is determined using Assay I as disclosed herein.

In an embodiment of each and any aspect of the invention, including any embodiment thereof, the Tm30-value is determined using Assay II as disclosed herein.

In an embodiment of each and any aspect of the invention, including any embodiment thereof, the Tm50-value is determined using Assay I as disclosed herein.

In an embodiment of each and any aspect of the invention, including any embodiment thereof, the Tm50-value is determined using Assay II as disclosed herein.

It is within the present invention that the trehalose phosphorylase of each and any aspect of the invention, including any embodiment thereof, is present in one of the following forms: a liquid solution, a dry powder, a freeze-dried powder, in an immobilized form.

In embodiments of each and any aspect of the present invention, including any embodiment thereof, the following definitions apply.

Definition Thermal Stability:

Thermal stability is the ability of an enzyme to resist irreversible inactivation after exposure to a specified elevated temperature over a given period of time. Residual activity of an enzyme incubated at the elevated temperature for a certain time is calculated as relative of the enzyme activity to a sample of the enzyme that has not been incubated at the elevated temperature. The enzyme activity can be determined in principle by using any activity assay. For the purpose of this invention Assay 1 or Assay 2 as described below, have been used as specified in the examples.

There are many ways of measuring and describing thermal stability. For the purpose of this invention thermal stability was determined by measuring and describing one or more of the following characteristics:

Tm30-Value:

For the purpose of this invention, the Tm30-value is the temperature at which the enzyme possesses 30% of its initial activity after incubation for 15 min at this temperature in a buffer containing 1 M sucrose. The initial activity is the activity of the respective enzyme without temperature treatment, i.e. with 15 min incubation at room temperature. The enzyme activity can be determined in principle by using any activity assay; for the purpose of this invention Assay 1 or Assay 2 as described below have been used, as specified in the examples.

Tm50-Value:

For the purpose of this invention, the Tm50-value is the temperature at which the enzyme possesses 50% of its initial activity after incubation for 15 min at this temperature in a buffer containing 1 M sucrose. The initial activity is the activity of the respective enzyme without temperature treatment, i.e. with 15 min incubation at room temperature. The enzyme activity can be determined in principle by using any activity assay; for the purpose of this invention Assay 1 or Assay 2 as described below have been used, as specified in the examples.

Process Stability/Half-Life:

For the purpose of this invention, long-term stability was determined in 50 mM potassium phosphate buffer pH 7 with 1 M sucrose at 40 or 45° C., respectively, as indicated in the examples. The half-life is defined as the duration of time after which the enzyme possesses 50% of the activity at t=0 min. The enzyme activity can be determined in principle by using any activity assay; for the purpose of this invention Assay 1 or Assay 2 as described below have been used, as specified in the examples.

Definition of Phosphorolysis Activity and Synthesis Activity:

As TPs catalyze the reversible phosphorolytic cleavage of trehalose, activity can be determined either in the direction of trehalose phosphorolysis or synthesis. For the purpose of this invention, phosphorolysis activity is defined as the activity for trehalose cleavage in the presence of inorganic phosphate to aG1P and glucose at the conditions described below as Assay 1. Synthesis activity is defined as the activity for trehalose synthesis from aG1P and glucose at the conditions described below as Assay 2. It is within the present invention that any activity and any activity of the trehalose phosphorylase is in an embodiment a catalytic activity.

Assay I: Phosphorolytic activity was routinely assayed at 30° C. using a continuous coupled assay in which the aG1P produced from trehalose is converted to glucose-6-phosphate by phosphoglucomutase. Glucose-6-phosphate and NADP is converted to 6-phospho-gluconate and NADPH by glucose 6-phosphate dehydrogenase. The detection is based on measuring the absorbance of NADPH at 340 nm. The assay solution contained: 75 mM potassium phosphate buffer pH 7, 2.5 mM NADP, 10 µM glucose 1,6-bisphosphate, 10 mM MgCl2, 225 mM trehalose, 3 U/mL phosphoglucomutase and 3.4 U/mL glucose 6-phosphate dehydrogenase.

Assay II: Synthetic activity was routinely assayed at 40° C. using the following conditions: 50 mM sodium MES buffer pH 7, 100 mM aG1P and 100 or 500 mM glucose concentrations as given. Reaction progress was determined discontinuously by measuring liberated phosphate with an assay based on the complex formation with molybdate under acidic conditions. The molybdate complex is reduced by ferrous sulfate and yields a blue color, which is analyzed photometrically at 750 nm. For the analysis 250 µL of sample are mixed with 250 µL 0.5 M HCl and 500 µL molybdate-reagent (73.2 g/L Fe(II)SO4*7H2O and 10 g/L ammonium molybdate*4H2O in 3.5% sulfuric acid). After incubation at RT for 15-30 min, absorbance is measured at 750 nm. The amount of inorganic phosphate in the sample is quantified using external standards.

Definition S/P-Ratio:

For the purpose of this invention, the S/P-ratio is defined as the ratio between phosphorolysis activity and synthesis activity measured by Assay 1 and Assay 2, respectively, using 500 mM glucose as described in the examples.

Definition 100/500-Ratio:

For the purpose of this invention, the 100/500-ratio is the ratio between activity of a TP variant using 100 mM glucose and activity of a TP variant using 500 mM glucose with 100 mM aG1P, respectively, according to Assay 2. An increase in 100/500-ratio of an enzyme variant compared to the wild-type enzyme is indicative of a decreased $K_M$-value for glucose.

In an embodiment, if not indicated to the contrary any activity, enzymatic activity, phosphorolysis activity and synthesis activity displayed or to be displayed by the polypeptide and, preferably any trehalose phosphorylase, of the present invention is defined and, respectively, determined by the methods and assays, respectively, disclosed herein.

TABLE 2

Overview over the Sequence IDs: Wild type Trehalose Phosphorylases

| SEQ ID | source |
|---|---|
| SEQ ID NO: 1 | wild-type, S. commune |
| SEQ ID NO: 80 | wild type, Hypholoma sublateritium FD-334 SS-4, Genbank: KJA27491.1 |
| SEQ ID NO: 81 | wild type, Grifola frondosa, Genbank: ADM15725 |
| SEQ ID NO: 82 | wild type, Pleurotus ostreatus, Genbank: KDQ33172.1 |
| SEQ ID NO: 83 | wild type, Lentinus sajor-caju, UniProtKB/Swiss-Prot: Q9UV63.1 |
| SEQ ID NO: 160 | wild type, Grifola frondosa, UniProtKB/Swiss-Prot: O75003.1 |
| SEQ ID NO: 191 | Schizophyllum commune H4-8, NCBI Reference Sequence: XP_003035156.1 |
| SEQ ID NO: 192 | Trametes cinnabarina, Genbank: CDO74881.1 |
| SEQ ID NO: 193 | Hypsizygus marmoreus, Genbank: KYQ39707.1 |
| SEQ ID NO: 194 | Trametes versicolor FP-101664 SS1, NCBI Reference Sequence: XP_008036133.1 |
| SEQ ID NO: 195 | Pleurotus pulmonarius, UniProtKB/Swiss-Prot: A6YRN9.1 |
| SEQ ID NO: 196 | Agaricus bisporus var. bisporus H97, NCBI Reference Sequence: XP_006458503.1 |
| SEQ ID NO: 197 | Agaricus bisporus var. burnettii JB137-S8, NCBI Reference Sequence: XP_007326883.1 |
| SEQ ID NO: 198 | Laetiporus sulphureus 93-53, Genbank: KZT11205.1 |
| SEQ ID NO: 199 | Gloeophyllum trabeum ATCC 11539, NCBI Reference Sequence: XP_007863746.1 |
| SEQ ID NO: 200 | Grifola frondosa, Genbank: OBZ75413.1 |
| SEQ ID NO: 201 | Trametes pubescens, Genbank: OJT04097.1 |

Table 3: Overview over the Sequence IDs: Variants of Trehalose Phosphorylase of SEQ ID NO:1

| SEQ ID | source | number of mutations in variant | mutations to SEQ ID NO: 1 |
|---|---|---|---|
| SEQ ID NO: 2 | variant of SEQ ID NO: 1 | 1 | K705N |
| SEQ ID NO: 3 | variant of SEQ ID NO: 1 | 2 | P383S, L712M |
| SEQ ID NO: 4 | variant of SEQ ID NO: 1 | 2 | K705N, L712M |
| SEQ ID NO: 5 | variant of SEQ ID NO: 1 | 3 | V10R, A506S, L712M |
| SEQ ID NO: 6 | variant of SEQ ID NO: 1 | 4 | V10R, Y220F, A506S, L712M |

-continued

| SEQ ID | source | number of mutations in variant | mutations to SEQ ID NO: 1 |
|---|---|---|---|
| SEQ ID NO: 7 | variant of SEQ ID NO: 1 | 4 | V10R, L114I, Y220F, L712M |
| SEQ ID NO: 8 | variant of SEQ ID NO: 1 | 4 | Y220F, A506S, K705N, L712M |
| SEQ ID NO: 9 | variant of SEQ ID NO: 1 | 6 | V10R, L114I, Y220F, A506S, K705N, L712M |
| SEQ ID NO: 10 | variant of SEQ ID NO: 1 | 2 | P383V, L712M |
| SEQ ID NO: 11 | variant of SEQ ID NO: 1 | 8 | L114I, I118V, P383V, Q476G, K488A, A506S, A511S, L712M |
| SEQ ID NO: 12 | variant of SEQ ID NO: 1 | 9 | L114I, I118V, A304I, F349Y, G357A, P383V, A506S, A511S, L712M |
| SEQ ID NO: 13 | variant of SEQ ID NO: 1 | 7 | L114I, I118V, A304I, F349Y, P383V, E481I, L712M |
| SEQ ID NO: 14 | variant of SEQ ID NO: 1 | 6 | L114I, I118V, A304I, G357A, P383V, L712M |
| SEQ ID NO: 15 | variant of SEQ ID NO: 1 | 8 | L114I, I118V, F349Y, G357A, P383V, E481I, K488A, L712M |
| SEQ ID NO: 16 | variant of SEQ ID NO: 1 | 8 | L114I, I118V, A304I, P383V, E481I, A506S, A511S, L712M |
| SEQ ID NO: 17 | variant of SEQ ID NO: 1 | 7 | L114I, I118V, P383V, K488A, A506S, A511S, L712M |
| SEQ ID NO: 18 | variant of SEQ ID NO: 1 | 9 | L114I, I118V, A304I, G357A, P383V, K488A, A506S, A511S, L712M |
| SEQ ID NO: 19 | variant of SEQ ID NO: 1 | 5 | L114I, I118V, P383V, E481I, L712M |
| SEQ ID NO: 20 | variant of SEQ ID NO: 1 | 7 | L114I, I118V, A304I, F349Y, P383V, K488A, L712M |
| SEQ ID NO: 21 | variant of SEQ ID NO: 1 | 7 | L114I, I118V, P383V, E481I, A506S, A511S, L712M |
| SEQ ID NO: 22 | variant of SEQ ID NO: 1 | 7 | L114I, I118V, S192V, A304I, G357A, P383V, L712M |
| SEQ ID NO: 23 | variant of SEQ ID NO: 1 | 7 | L114I, I118V, S197G, A304I, G357A, P383V, L712M |
| SEQ ID NO: 24 | variant of SEQ ID NO: 1 | 7 | L114I, I118V, N225V, A304I, G357A, P383V, L712M |
| SEQ ID NO: 25 | variant of SEQ ID NO: 1 | 7 | L114I, I118V, A304I, D306H, G357A, P383V, L712M |
| SEQ ID NO: 26 | variant of SEQ ID NO: 1 | 7 | L114I, I118V, A304I, P318H, G357A, P383V, L712M |
| SEQ ID NO: 27 | variant of SEQ ID NO: 1 | 7 | L114I, I118V, A304I, T323I, G357A, P383V, L712M |
| SEQ ID NO: 28 | variant of SEQ ID NO: 1 | 7 | L114I, I118V, A304I, L339I, G357A, P383V, L712M |
| SEQ ID NO: 29 | variant of SEQ ID NO: 1 | 7 | L114I, I118V, A304I, F349Y, G357A, P383V, L712M |
| SEQ ID NO: 30 | variant of SEQ ID NO: 1 | 7 | L114I, I118V, A304I, G357A, P383V, A459S, L712M |
| SEQ ID NO: 31 | variant of SEQ ID NO: 1 | 7 | L114I, I118V, A304I, G357A, P383V, E481I, L712M |
| SEQ ID NO: 32 | variant of SEQ ID NO: 1 | 7 | L114I, I118V, A304I, G357A, P383V, A484S, L712M |
| SEQ ID NO: 33 | variant of SEQ ID NO: 1 | 7 | L114I, I118V, A304I, G357A, P383V, Q487V, L712M |
| SEQ ID NO: 34 | variant of SEQ ID NO: 1 | 7 | L114I, I118V, A304I, G357A, P383V, Q487A, L712M |
| SEQ ID NO: 35 | variant of SEQ ID NO: 1 | 7 | L114I, I118V, A304I, G357A, P383V, Q487L, L712M |
| SEQ ID NO: 36 | variant of SEQ ID NO: 1 | 7 | L114I, I118V, A304I, G357A, P383V, R526E, L712M |
| SEQ ID NO: 37 | variant of SEQ ID NO: 1 | 7 | L114I, I118V, A304I, G357A, P383V, E530V, L712M |
| SEQ ID NO: 38 | variant of SEQ ID NO: 1 | 7 | L114I, I118V, A304I, G357A, P383V, G532R, L712M |
| SEQ ID NO: 39 | variant of SEQ ID NO: 1 | 7 | L114I, I118V, A304I, G357A, P383V, D533G, L712M |
| SEQ ID NO: 40 | variant of SEQ ID NO: 1 | 7 | L114I, I118V, A304I, G357A, P383V, D537M, L712M |
| SEQ ID NO: 41 | variant of SEQ ID NO: 1 | 7 | L114I, I118V, A304I, G357A, P383V, V550I, L712M |
| SEQ ID NO: 42 | variant of SEQ ID NO: 1 | 7 | L114I, I118V, A304I, G357A, P383V, S556T, L712M |
| SEQ ID NO: 43 | variant of SEQ ID NO: 1 | 7 | L114I, I118V, A304I, G357A, P383V, T564E, L712M |

-continued

| SEQ ID | source | number of mutations in variant | mutations to SEQ ID NO: 1 |
|---|---|---|---|
| SEQ ID NO: 44 | variant of SEQ ID NO: 1 | 7 | L114I, I118V, A304I, G357A, P383V, D590N, L712M |
| SEQ ID NO: 45 | variant of SEQ ID NO: 1 | 7 | L114I, I118V, A304I, G357A, P383V, D590A, L712M |
| SEQ ID NO: 46 | variant of SEQ ID NO: 1 | 7 | L114I, I118V, A304I, G357A, P383V, A649E, L712M |
| SEQ ID NO: 47 | variant of SEQ ID NO: 1 | 7 | L114I, I118V, A304I, G357A, P383V, R667E, L712M |
| SEQ ID NO: 48 | variant of SEQ ID NO: 1 | 7 | L114I, I118V, A304I, G357A, P383V, R667K, L712M |
| SEQ ID NO: 49 | variant of SEQ ID NO: 1 | 7 | L114I, I118V, A304I, G357A, P383V, A703E, L712M |
| SEQ ID NO: 50 | variant of SEQ ID NO: 1 | 9 | L114I, I118V, A304I, G357A, P383V, V550I, S556T, D590N, L712M |
| SEQ ID NO: 51 | variant of SEQ ID NO: 1 | 10 | L114I, I118V, N225V, A304I, G357A, P383V, Q487L, T564E, D590N, L712M |
| SEQ ID NO: 52 | variant of SEQ ID NO: 1 | 10 | L114I, I118V, A304I, T323I, G357A, P383V, V550I, T564E, D590N, L712M |
| SEQ ID NO: 53 | variant of SEQ ID NO: 1 | 10 | L114I, I118V, N225V, A304I, T323I, G357A, P383V, Q487L, D590N, L712M |
| SEQ ID NO: 54 | variant of SEQ ID NO: 1 | 11 | L114I, I118V, N225V, A304I, G357A, P383V, Q487L, V550I, S556T, D590N, L712M |
| SEQ ID NO: 55 | variant of SEQ ID NO: 1 | 11 | L114I, I118V, N225V, A304I, G357A, P383V, Q487L, V550I, T564E, D590N, L712M |
| SEQ ID NO: 56 | variant of SEQ ID NO: 1 | 11 | L114I, I118V, N225V, A304I, G357A, P383V, V550I, S556T, T564E, D590N, L712M |
| SEQ ID NO: 57 | variant of SEQ ID NO: 1 | 11 | L114I, I118V, N225V, A304I, G357A, P383V, V550I, T564E, D590N, A649E, L712M |
| SEQ ID NO: 58 | variant of SEQ ID NO: 1 | 11 | L114I, I118V, A304I, T323I, G357A, P383V, V550I, S556T, T564E, D590N, L712M |
| SEQ ID NO: 59 | variant of SEQ ID NO: 1 | 11 | L114I, I118V, A304I, T323I, G357A, P383V, Q487L, V550I, D590N, A649E, L712M |
| SEQ ID NO: 60 | variant of SEQ ID NO: 1 | 12 | L114I, I118V, N225V, A304I, G357A, P383V, Q487A, V550I, S556T, T564E, D590N, L712M |
| SEQ ID NO: 61 | variant of SEQ ID NO: 1 | 12 | L114I, I118V, N225V, A304I, G357A, P383V, V550I, S556T, T564E, D590N, A649E, L712M |
| SEQ ID NO: 62 | variant of SEQ ID NO: 1 | 12 | L114I, I118V, N225V, A304I, T323I, G357A, P383V, Q487L, V550I, T564E, D590N, L712M |
| SEQ ID NO: 63 | variant of SEQ ID NO: 1 | 12 | L114I, I118V, N225V, A304I, T323I, G357A, P383V, Q487L, V550I, D590N, A649E, L712M |
| SEQ ID NO: 64 | variant of SEQ ID NO: 1 | 12 | L114I, I118V, N225V, A304I, T323I, G357A, P383V, Q487A, V550I, S556T, D590N, L712M |
| SEQ ID NO: 65 | variant of SEQ ID NO: 1 | 12 | L114I, I118V, N225V, A304I, T323I, G357A, P383V, V550I, S556T, T564E, D590N, L712M |
| SEQ ID NO: 66 | variant of SEQ ID NO: 1 | 12 | L114I, I118V, A304I, T323I, F349Y, G357A, P383V, Q487L, V550I, D590N, A649E, L712M |
| SEQ ID NO: 67 | variant of SEQ ID NO: 1 | 12 | L114I, I118V, A304I, T323I, G357A, P383V, Q487A, V550I, S556T, T564E, D590N, L712M |
| SEQ ID NO: 68 | variant of SEQ ID NO: 1 | 12 | L114I, I118V, A304I, G357A, P383V, Q487A, V550I, S556T, T564E, D590N, A649E, L712M |
| SEQ ID NO: 69 | variant of SEQ ID NO: 1 | 12 | L114I, I118V, A304I, G357A, P383V, Q487L, V550I, S556T, T564E, D590N, A649E, L712M |
| SEQ ID NO: 70 | variant of SEQ ID NO: 1 | 13 | L114I, I118V, N225V, A304I, T323I, F349Y, G357A, P383V, V550I, S556T, D590N, A649E, L712M |
| SEQ ID NO: 71 | variant of SEQ ID NO: 1 | 13 | L114I, I118V, N225V, A304I, T323I, G357A, P383V, Q487L, V550I, S556T, D590N, A649E, L712M |
| SEQ ID NO: 72 | variant of SEQ ID NO: 1 | 13 | L114I, I118V, N225V, A304I, F349Y, G357A, P383V, Q487A, V550I, S556T, T564E, D590N, L712M |
| SEQ ID NO: 73 | variant of SEQ ID NO: 1 | 13 | L114I, I118V, N225V, A304I, F349Y, G357A, P383V, Q487L, V550I, T564E, D590N, A649E, L712M |
| SEQ ID NO: 74 | variant of SEQ ID NO: 1 | 13 | L114I, I118V, N225V, A304I, G357A, P383V, Q487L, V550I, S556T, T564E, D590N, A649E, L712M |
| SEQ ID NO: 75 | variant of SEQ ID NO: 1 | 13 | L114I, I118V, N225V, A304I, G357A, P383V, Q487A, V550I, S556T, T564E, D590N, A649E, L712M |
| SEQ ID NO: 76 | variant of SEQ ID NO: 1 | 13 | L114I, I118V, A304I, T323I, G357A, P383V, Q487L, V550I, S556T, T564E, D590N, A649E, L712M |
| SEQ ID NO: 77 | variant of SEQ ID NO: 1 | 13 | L114I, I118V, A304I, T323I, G357A, P383V, Q487L, V550I, S556T, T564E, D590N, A649E, L712M |
| SEQ ID NO: 78 | variant of SEQ ID NO: 1 | 14 | L114I, I118V, N225V, A304I, T323I, G357A, P383V, Q487A, V550I, S556T, T564E, D590N, A649E, L712M |
| SEQ ID NO: 79 | variant of SEQ ID NO: 1 | 14 | L114I, I118V, N225V, A304I, T323I, G357A, P383V, Q487G, V550I, S556T, T564E, D590N, A649E, L712M |
| SEQ ID NO: 84 | variant of SEQ ID NO: 1 | 1 | N225V |

-continued

| SEQ ID | source | number of mutations in variant | mutations to SEQ ID NO: 1 |
|---|---|---|---|
| SEQ ID NO: 85 | variant of SEQ ID NO: 1 | 1 | A304I |
| SEQ ID NO: 86 | variant of SEQ ID NO: 1 | 1 | T323I |
| SEQ ID NO: 87 | variant of SEQ ID NO: 1 | 1 | P383V |
| SEQ ID NO: 88 | variant of SEQ ID NO: 1 | 1 | Q487A |
| SEQ ID NO: 89 | variant of SEQ ID NO: 1 | 1 | S556T |
| SEQ ID NO: 90 | variant of SEQ ID NO: 1 | 1 | T564E |
| SEQ ID NO: 91 | variant of SEQ ID NO: 1 | 1 | D590N |
| SEQ ID NO: 92 | variant of SEQ ID NO: 1 | 1 | N225I |
| SEQ ID NO: 93 | variant of SEQ ID NO: 1 | 1 | N225L |
| SEQ ID NO: 94 | variant of SEQ ID NO: 1 | 1 | N225M |
| SEQ ID NO: 95 | variant of SEQ ID NO: 1 | 1 | A304L |
| SEQ ID NO: 96 | variant of SEQ ID NO: 1 | 1 | T323V |
| SEQ ID NO: 97 | variant of SEQ ID NO: 1 | 1 | P383A |
| SEQ ID NO: 98 | variant of SEQ ID NO: 1 | 1 | P383G |
| SEQ ID NO: 99 | variant of SEQ ID NO: 1 | 1 | P383M |
| SEQ ID NO: 100 | variant of SEQ ID NO: 1 | 1 | P383N |
| SEQ ID NO: 101 | variant of SEQ ID NO: 1 | 1 | P383C |
| SEQ ID NO: 102 | variant of SEQ ID NO: 1 | 1 | P383Q |
| SEQ ID NO: 103 | variant of SEQ ID NO: 1 | 1 | P383S |
| SEQ ID NO: 104 | variant of SEQ ID NO: 1 | 1 | P383T |
| SEQ ID NO: 105 | variant of SEQ ID NO: 1 | 1 | Q487G |
| SEQ ID NO: 106 | variant of SEQ ID NO: 1 | 1 | Q487L |
| SEQ ID NO: 107 | variant of SEQ ID NO: 1 | 1 | Q487M |
| SEQ ID NO: 108 | variant of SEQ ID NO: 1 | 1 | V550P |
| SEQ ID NO: 109 | variant of SEQ ID NO: 1 | 1 | D590G |
| SEQ ID NO: 110 | variant of SEQ ID NO: 1 | 2 | I118V, P383V |
| SEQ ID NO: 111 | variant of SEQ ID NO: 1 | 2 | I118V, S556T |
| SEQ ID NO: 112 | variant of SEQ ID NO: 1 | 2 | I118V, T564E |
| SEQ ID NO: 113 | variant of SEQ ID NO: 1 | 2 | I118V, D590N |
| SEQ ID NO: 114 | variant of SEQ ID NO: 1 | 2 | N225V, A304I |
| SEQ ID NO: 115 | variant of SEQ ID NO: 1 | 2 | N225V, P383V |
| SEQ ID NO: 116 | variant of SEQ ID NO: 1 | 2 | N225V, Q487A |
| SEQ ID NO: 117 | variant of SEQ ID NO: 1 | 2 | N225V, V550I |
| SEQ ID NO: 118 | variant of SEQ ID NO: 1 | 2 | N225V, S556T |
| SEQ ID NO: 119 | variant of SEQ ID NO: 1 | 2 | N225V, D590N |
| SEQ ID NO: 120 | variant of SEQ ID NO: 1 | 2 | A304I, T323I |
| SEQ ID NO: 121 | variant of SEQ ID NO: 1 | 2 | A304I, P383V |

-continued

| SEQ ID | source | number of mutations in variant | mutations to SEQ ID NO: 1 |
|---|---|---|---|
| SEQ ID NO: 122 | variant of SEQ ID NO: 1 | 2 | A304I, Q487A |
| SEQ ID NO: 123 | variant of SEQ ID NO: 1 | 2 | A304I, S556T |
| SEQ ID NO: 124 | variant of SEQ ID NO: 1 | 2 | A304I, T564E |
| SEQ ID NO: 125 | variant of SEQ ID NO: 1 | 2 | A304I, D590N |
| SEQ ID NO: 126 | variant of SEQ ID NO: 1 | 2 | T323I, G357A |
| SEQ ID NO: 127 | variant of SEQ ID NO: 1 | 2 | T323I, Q487A |
| SEQ ID NO: 128 | variant of SEQ ID NO: 1 | 2 | T323I, S556T |
| SEQ ID NO: 129 | variant of SEQ ID NO: 1 | 2 | T323I, T564E |
| SEQ ID NO: 130 | variant of SEQ ID NO: 1 | 2 | T323I, D590N |
| SEQ ID NO: 131 | variant of SEQ ID NO: 1 | 2 | T323I, A649E |
| SEQ ID NO: 132 | variant of SEQ ID NO: 1 | 2 | F349Y, P383V |
| SEQ ID NO: 133 | variant of SEQ ID NO: 1 | 2 | F349Y, D590N |
| SEQ ID NO: 134 | variant of SEQ ID NO: 1 | 2 | G357A, P383V |
| SEQ ID NO: 135 | variant of SEQ ID NO: 1 | 2 | G357A, D590N |
| SEQ ID NO: 136 | variant of SEQ ID NO: 1 | 2 | P383V, Q487A |
| SEQ ID NO: 137 | variant of SEQ ID NO: 1 | 2 | P383V, V550I |
| SEQ ID NO: 138 | variant of SEQ ID NO: 1 | 2 | P383V, S556T |
| SEQ ID NO: 139 | variant of SEQ ID NO: 1 | 2 | P383V, T564E |
| SEQ ID NO: 140 | variant of SEQ ID NO: 1 | 2 | P383V, D590N |
| SEQ ID NO: 141 | variant of SEQ ID NO: 1 | 2 | P383V, A649E |
| SEQ ID NO: 142 | variant of SEQ ID NO: 1 | 2 | Q487A, T564E |
| SEQ ID NO: 143 | variant of SEQ ID NO: 1 | 2 | Q487A, D590N |
| SEQ ID NO: 144 | variant of SEQ ID NO: 1 | 2 | Q487A, A649E |
| SEQ ID NO: 145 | variant of SEQ ID NO: 1 | 2 | V550I, D590N |
| SEQ ID NO: 146 | variant of SEQ ID NO: 1 | 2 | S556T, T564E |
| SEQ ID NO: 147 | variant of SEQ ID NO: 1 | 2 | S556T, D590N |
| SEQ ID NO: 148 | variant of SEQ ID NO: 1 | 2 | S556T, A649E |
| SEQ ID NO: 149 | variant of SEQ ID NO: 1 | 2 | T564E, D590N |
| SEQ ID NO: 150 | variant of SEQ ID NO: 1 | 2 | T564E, L712M |
| SEQ ID NO: 151 | variant of SEQ ID NO: 1 | 2 | D590N, A649E |
| SEQ ID NO: 152 | variant of SEQ ID NO: 1 | 2 | D590N, L712M |
| SEQ ID NO: 153 | variant of SEQ ID NO: 1 | 2 | A649E, L712M |
| SEQ ID NO: 154 | variant of SEQ ID NO: 1 | 13 | L114I, N225V, A304I, T323I, G357A, P383V, Q487A, V550I, S556T, T564E, D590N, A649E, L712M |
| SEQ ID NO: 155 | variant of SEQ ID NO: 1 | 13 | L114I, I118V, N225V, T323I, G357A, P383V, Q487A, V550I, S556T, T564E, D590N, A649E, L712M |
| SEQ ID NO: 156 | variant of SEQ ID NO: 1 | 13 | L114I, I118V, N225V, A304I, T323I, P383V, Q487A, V550I, S556T, T564E, D590N, A649E, L712M |
| SEQ ID NO: 157 | variant of SEQ ID NO: 1 | 13 | L114I, I118V, N225V, A304I, T323I, G357A, Q487A, V550I, S556T, T564E, D590N, A649E, L712M |
| SEQ ID NO: 158 | variant of SEQ ID NO: 1 | 13 | L114I, I118V, N225V, A304I, T323I, G357A, P383V, Q487A, V550I, S556T, T564E, A649E, L712M |

-continued

| SEQ ID | source | number of mutations in variant | mutations to SEQ ID NO: 1 |
|---|---|---|---|
| SEQ ID NO: 159 | variant of SEQ ID NO: 1 | 13 | L114I, I118V, N225V, A304I, T323I, G357A, P383V, Q487A, V550I, S556T, T564E, D590N, A649E |
| SEQ ID NO: 190 | variant of SEQ ID NO: 1 | 14 | L114I, I118V, N225V, A304I, T323I, G357A, P383V, Q487L, V550I, S556T, T564E, D590N, A649E, L712M |

TABLE 4

Overview over the Sequence IDs: Variant Trehalose Phosphorylase of SEQ ID NO: 160

| SEQ ID | source | number of mutations in variant | mutations to SEQ ID NO: 160 |
|---|---|---|---|
| SEQ ID NO: 161 | variant of SEQ ID NO: 160 | 1 | L108I |
| SEQ ID NO: 162 | variant of SEQ ID NO: 160 | 1 | V112I |
| SEQ ID NO: 163 | variant of SEQ ID NO: 160 | 1 | N221V |
| SEQ ID NO: 164 | variant of SEQ ID NO: 160 | 1 | A300I |
| SEQ ID NO: 165 | variant of SEQ ID NO: 160 | 1 | T319I |
| SEQ ID NO: 166 | variant of SEQ ID NO: 160 | 1 | P379V |
| SEQ ID NO: 167 | variant of SEQ ID NO: 160 | 1 | S550T |
| SEQ ID NO: 168 | variant of SEQ ID NO: 160 | 1 | Q558E |
| SEQ ID NO: 169 | variant of SEQ ID NO: 160 | 1 | A643E |
| SEQ ID NO: 170 | variant of SEQ ID NO: 160 | 1 | L707M |
| SEQ ID NO: 171 | variant of SEQ ID NO: 160 | 2 | L108I, N221V |
| SEQ ID NO: 172 | variant of SEQ ID NO: 160 | 2 | L108I, A300I |
| SEQ ID NO: 173 | variant of SEQ ID NO: 160 | 2 | L108I, T319I |
| SEQ ID NO: 174 | variant of SEQ ID NO: 160 | 2 | L108I, V483A |
| SEQ ID NO: 175 | variant of SEQ ID NO: 160 | 2 | L108I, S550T |
| SEQ ID NO: 176 | variant of SEQ ID NO: 160 | 2 | P379V, L108I |
| SEQ ID NO: 177 | variant of SEQ ID NO: 160 | 2 | P379V, V112I |
| SEQ ID NO: 178 | variant of SEQ ID NO: 160 | 2 | P379V, N221V |
| SEQ ID NO: 179 | variant of SEQ ID NO: 160 | 2 | P379V, A300I |
| SEQ ID NO: 180 | variant of SEQ ID NO: 160 | 2 | P379V, T319I |
| SEQ ID NO: 181 | variant of SEQ ID NO: 160 | 2 | P379V, F345Y |
| SEQ ID NO: 182 | variant of SEQ ID NO: 160 | 2 | P379V, V483A |
| SEQ ID NO: 183 | variant of SEQ ID NO: 160 | 2 | P379V, V544I |
| SEQ ID NO: 184 | variant of SEQ ID NO: 160 | 2 | P379V, S550T |
| SEQ ID NO: 185 | variant of SEQ ID NO: 160 | 3 | P379V, V483A, Q558E |
| SEQ ID NO: 186 | variant of SEQ ID NO: 160 | 3 | P379V, V544I, S550T |
| SEQ ID NO: 187 | variant of SEQ ID NO: 160 | 3 | P379V, V544I, Q558E |
| SEQ ID NO: 188 | variant of SEQ ID NO: 160 | 3 | P379V, S550T, Q558E |
| SEQ ID NO: 189 | variant of SEQ ID NO: 160 | 4 | P379V, V483A, V544I, Q558E |

TABLE 5

Amino acids and corresponding positions after alignment with SEQ ID NO: 1 of different wild type TPs at the positions 114, 118, 225, 304, 323, 349, 383, 487, 550, 556, 564, 590, 649, 712 of SEQ ID NO: 1 (The alignment was done using Clustal omega (Goujon M, McWilliam H, Li W, Valentin F, Squizzato S, Paern J, Lopez R Nucleic acids research 2010 July, 38 Suppl: W695-9).

| SEQ ID | Source | Genbank/Uniprot | | 114 | 118 | 225 | 304 |
|---|---|---|---|---|---|---|---|
| SEQ ID NO: 1 | Schizophyllum commune | ABC84380.1 | postition amino acid | 114 L | 118 I | 225 N | 304 A |
| SEQ ID NO: 191 | Schizophyllum commune H4-8 | XP_003035156.1 | postition amino acid | 114 L | 118 I | 225 N | 304 A |
| SEQ ID NO: 80 | Hypholoma sublateritium FD-334 SS-4 | KJA27491.1 | postition amino acid | 70 L | 74 V | 183 N | 262 A |
| SEQ ID NO: 192 | Trametes cinnabarina | CDO74881.1 | postition amino acid | 108 L | 112 V | 221 N | 300 A |
| SEQ ID NO: 193 | Hypsizygus marmoreus | KYQ39707.1 | postition amino acid | 2 P | 6 S | 115 N | 194 L |
| SEQ ID NO: 160 | Grifola frondosa | O75003.1 | postition amino acid | 108 L | 112 V | 221 N | 300 A |
| SEQ ID NO: 81 | Grifola frondosa | ADM15725.1 | postition amino acid | 108 L | 112 V | 221 N | 300 A |

TABLE 5-continued

Amino acids and corresponding positions after alignment with SEQ ID NO: 1 of different wild type TPs at the positions 114, 118, 225, 304, 323, 349, 383, 487, 550, 556, 564, 590, 649, 712 of SEQ ID NO: 1 (The alignment was done using Clustal omega (Goujon M, McWilliam H, Li W, Valentin F, Squizzato S, Paern J, Lopez R Nucleic acids research 2010 July, 38 Suppl: W695-9).

| SEQ ID NO: 194 | Trametes versicolor FP-101664 SS1 | XP_008036133.1 | postition amino acid | 110 L | 114 I | 223 N | 302 A |
|---|---|---|---|---|---|---|---|
| SEQ ID NO: 82 | Pleurotus ostreatus PC15 | KDQ33172.1 | postition amino acid | 112 L | 116 I | 225 N | 304 A |
| SEQ ID NO: 195 | Pleurotus pulmonarius | A6YRN9.1 | postition amino acid | 111 L | 115 V | 224 N | 303 L |
| SEQ ID NO: 196 | Agaricus bisporus var. bisporus H97 | XP_006458503.1 | postition amino acid | 110 L | 114 V | 223 N | 302 A |
| SEQ ID NO: 197 | Agaricus bisporus var. burnettii JB137-S8 | XP_007326883.1 | postition amino acid | 110 L | 114 V | 223 N | 302 A |
| SEQ ID NO: 198 | Laetiporus sulphureus 93-53 | KZT11205.1 | postition amino acid | 108 L | 112 V | 221 N | 300 A |
| SEQ ID NO: 83 | Lentinus sajor-caju (Pleurotus sajor-caju) | Q9UV63.1 | postition amino acid | 112 L | 116 I | 225 N | 304 A |
| SEQ ID NO: 199 | Gloeophyllum trabeum ATCC 11539 | XP_007863746.1 | postition amino acid | 106 L | 110 V | 227 N | 306 L |
| SEQ ID NO: 200 | Grifola frondosa | OBZ75413.1 | postition amino acid | 108 L | 112 V | 221 N | 300 V |
| SEQ ID NO: 201 | Trametes pubescens | OJT04097.1 | postition amino acid | 70 L | 74 V | 183 N | — |

| SEQ ID | 323 | 349 | 383 | 487 | 550 | 556 | 564 | 590 | 649 | 712 |
|---|---|---|---|---|---|---|---|---|---|---|
| SEQ ID NO: 1 | T | F | P | Q | V | S | T | D | A | L |
| SEQ ID NO: 191 | 323 T | 349 F | 383 P | 487 Q | 550 V | 556 S | 564 T | 590 D | 649 V | 712 L |
| SEQ ID NO: 80 | 281 T | 307 F | 341 P | 445 T | 509 V | 515 S | 523 Q | 550 N | 609 A | 672 M |
| SEQ ID NO: 192 | 319 T | 345 F | 379 P | 483 A | 546 V | 552 S | 560 Q | 587 N | 646 A | 709 M |
| SEQ ID NO: 193 | 213 T | 239 F | 273 P | 377 V | 438 V | 444 S | 452 Q | 478 N | 537 A | 601 L |
| SEQ ID NO: 160 | 319 T | 345 F | 379 P | 483 V | 544 V | 550 S | 558 Q | 584 N | 643 A | 707 L |
| SEQ ID NO: 81 | 319 T | 345 F | 379 P | 483 I | 544 V | 550 S | 558 Q | 584 N | 643 A | 707 L |
| SEQ ID NO: 194 | 321 T | 347 F | 381 P | 485 A | 549 V | 555 S | 563 A | 590 N | 649 D | 712 L |
| SEQ ID NO: 82 | 323 T | 349 F | 383 P | 487 A | 551 V | 557 S | 565 A | 592 N | 651 D | 714 L |
| SEQ ID NO: 195 | 322 T | 348 F | 382 P | 486 V | 547 V | 553 S | 561 Q | 587 N | 646 A | 710 L |
| SEQ ID NO: 196 | 321 T | 347 F | 381 P | 485 A | 549 V | 555 S | 563 Q | 590 N | 649 E | 712 L |
| SEQ ID NO: 197 | 321 T | 347 F | 381 P | 485 A | 549 V | 555 S | 563 Q | 590 N | 649 E | 712 L |
| SEQ ID NO: 198 | 319 T | 345 F | 380 P | 484 A | 545 V | 551 S | 559 A | 585 N | 644 E | 708 M |
| SEQ ID NO: 83 | 323 T | 349 F | 383 P | 499 A | 563 V | 569 S | 577 A | 604 N | 663 D | 726 F |
| SEQ ID NO: 199 | 325 T | 351 F | 385 P | 489 V | 552 V | 558 S | 566 G | 592 N | 651 E | 715 L |
| SEQ ID NO: 200 | 319 T | 345 F | 379 P | 483 S | 505 V | 511 S | 519 Q | 545 N | 604 A | 668 L |
| SEQ ID NO: 201 | — | 263 F | 297 P | 401 V | 462 V | 468 S | 476 Q | 502 N | 561 A | 625 L |

Figure 2:
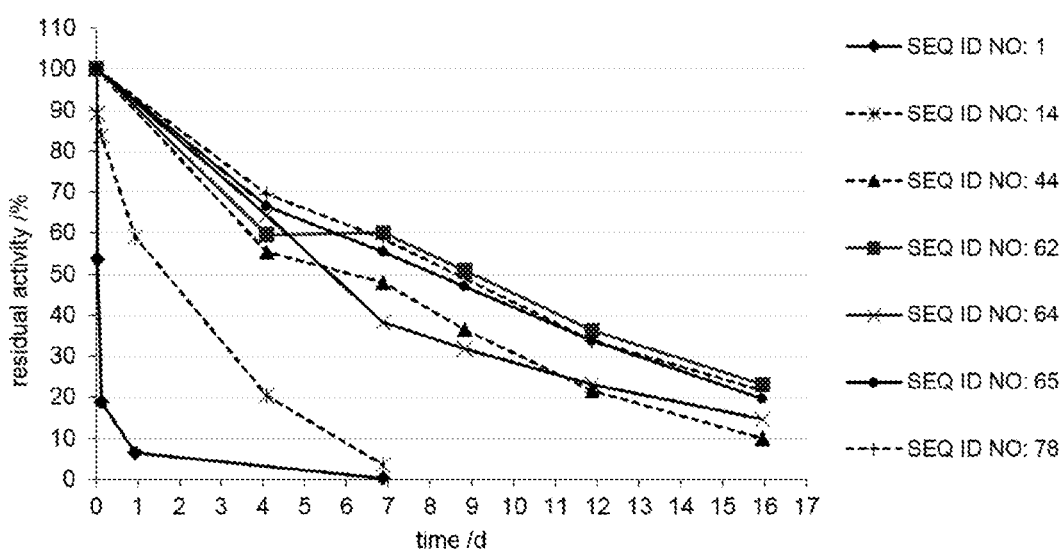

The present invention is further illustrated by the figures, examples and the sequence listing from which further features, embodiments and advantages may be taken, wherein FIG. 1 is a diagram showing residual activity in % as a function of temperature for wild type trehalose phosphorylase of SEQ ID NO: 1 in the presence and in the absence of 1M sucrose added a stabilizing agent; and FIG. 2 is a diagram showing residual activity in % as a function of time for wild type trehalose phosphorylase of SEQ ID NO: 1 and various trehalose phosphorylases of the invention; and FIG. 3 shows an alignment of the wild type TPs from Grifola frondosa (UniProtKB/Swiss-Prot: Accession No: O75003.1 and Genebank Accession No: ADM15725.1),

*Pleurotus ostreatus* (Genebank Accession No: KDQ33172.1), *Lentinus sajor-caju* (Synonym: *Pleurotus sajor-caju*, Genebank Accession No: Q9UV63.1). The alignment was done using Clustal omega (Goujon M, McWilliam H, Li W, Valentin F, Squizzato S, Paern J, Lopez R Nucleic acids research 2010 July, 38 Suppl: W695-9).

The features of the present invention disclosed in the specification, the claims, the sequence listing and/or the drawings may both separately and in any combination thereof be material for realizing the invention in various forms thereof.

EXAMPLES

Example 1: General Methods

Cloning of the wild type TP: The trehalose phosphorylase gene from *S. commune* was codon-optimized for expression in *E. coli* and synthesized by Eurofins MWG Operon. The gene was cloned into the expression vector pLE1A17 (derivative of pRSF-1b, Novagen). The resulting plasmids were used for transformation of *E. coli* BL21(DE3) cells.

Molecular biology methods: Mutants of the TP enzymes were created by standard site-directed mutagenesis technologies as known in the state of the art.

Expression of recombinant TPs: Recombinant TPs were routinely expressed by inoculating Medium I (4.6 g/L yeast extract, 9.3 g/L peptone, 25 mM Na2HPO4*12H2O, 25 mM KH2PO4, 50 mM NH4Cl2, Na2SO4, 5 g/L glycerol, 0.5 g/L glucose*1H2O, 2 mM MgSO4, 50 µg/mL kanamycin) with a fresh overnight culture. Cultures were grown at 37° C. up to an optical density at 600 nm of 0.6-0.8. Cultures were induced with 0.1 mM IPTG final concentration. Expression was at 24-25° C. overnight.

Preparation of TP enzyme preparations: Preparation of cell free extract was done using procedures well known as described elsewhere. Cells were harvested by centrifugation and suspended in a buffer containing 50 mM potassium phosphate-buffer pH 7, 2 mM MgCl2, 0.5 mg/mL lysozyme and 20 U/mL nuclease. 1 M sucrose was at times added as a stabilizing agent. Cell disruption was achieved by sonication or repeated freeze/thaw cycles. Cell free extract containing soluble enzyme was separated from the debris by centrifugation.

Activity measurements: Activity of trehalose phosphorylase can be determined in both the direction of trehalose cleavage (phosphorolytic activity) and synthesis (synthetic activity) as described in Assay I and Assay II:

Assay I: Phosphorolytic activity was routinely assayed at 30° C. using a continuous coupled assay in which the aG1P produced from trehalose is converted to glucose-6-phosphate by phosphoglucomutase. Glucose-6-phosphate and NADP is converted to 6-phospho-gluconate and NADPH by glucose 6-phosphate dehydrogenase. The detection is based on measuring the absorbance of NADPH at 340 nm. The assay solution contained: 75 mM potassium phosphate buffer pH 7, 2.5 mM NADP, 10 µM glucose 1,6-bisphosphate, 10 mM MgCl2, 225 mM trehalose, 3 U/mL phosphoglucomutase and 3.4 U/mL glucose 6-phosphate dehydrogenase.

Assay II: Synthetic activity was routinely assayed at 40° C. using the following conditions: 50 mM sodium MES buffer pH 7, 100 mM aG1P and 100 or 500 mM glucose concentrations as given. Reaction progress was determined discontinuously by measuring liberated phosphate with an assay based on the complex formation with molybdate under acidic conditions. The molybdate complex is reduced by ferrous sulfate and yields a blue color, which is analyzed photometrically at 750 nm. For the analysis 250 µL of sample are mixed with 250 µL 0.5 M HCl and 500 µL molybdate-reagent (73.2 g/L Fe(II)SO4*7H2O and 10 g/L ammonium molybdate*4H2O in 3.5% sulfuric acid). After incubation at RT for 15-30 min, absorbance is measured at 750 nm. The amount of inorganic phosphate in the sample is quantified using external standards.

Example 2: Effect of Sucrose on Thermal Stability

Expression of recombinant TPs: The wild-type enzyme SEQ ID NO: 1 was expressed in shaking flasks by inoculating Medium I (4.6 g/L yeast extract, 9.3 g/L peptone, 25 mM Na2HPO4*12H2O, 25 mM KH2PO4, 50 mM NH4Cl2, Na2SO4, 5 g/L glycerol, 0.5 g/L glucose*1H2O, 2 mM MgSO4, 50 µg/mL kanamycin) with a fresh overnight culture. Cultures were induced in the logarithmic phase with 0.1 mM IPTG and expressed overnight at 24-25° C.

Preparation of TP enzyme preparations: For the preparation of cell extract without sucrose cells were harvested by centrifugation and suspended in a buffer containing 50 mM potassium phosphate-buffer pH 7, 2 mM MgCl2, 0.5 mg/mL lysozyme and 20 U/mL nuclease. Cells were disrupted by sonication. Cell free extract containing soluble enzyme was separated from the debris by centrifugation. For the preparation of cell extract with sucrose as a stabilizing agent, cells were harvested by centrifugation and suspended in a buffer containing 100 mM potassium phosphate-buffer pH 7, 2 mM MgCl2, 0.5 mg/mL lysozyme and 20 U/mL nuclease. Cells were disrupted by sonication. Cell free extract containing soluble enzyme was separated from the debris by centrifugation and diluted 1:2 with 2 M sucrose solution.

Determination of denaturation profile: 50 µL aliquots of enzyme preparations with and without 1 M sucrose were incubated for 15 min at temperatures ranging from 36 to 53.7° C. Denatured protein was separated by centrifugation. The activity of the resulting supernatants as well as cell extract without a heat inactivation step was determined using Assay I. FIG. 1 is a denaturing profile of SEQ ID NO: 1 with and without 1 M sucrose as a stabilizing agent showing the obtained residual activities compared to the enzyme preparations without heat inactivation. The addition of 1 M sucrose results in an increase of Tm50 from approx. 40° C. to 47.5° C. 1 M sucrose was therefore chosen as a stabilizing agent for TP.

Example 3: Residual Activity of TP Variants after Incubation at 52° C. for 15 Min Expression of recombinant TPs: Recombinant TPs were expressed in deep-well plates by inoculating Medium I (4.6 g/L yeast extract, 9.3 g/L peptone, 25 mM Na2HPO4*12H2O, 25 mM KH2PO4, 50 mM NH4Cl2, Na2SO4, 5 g/L glycerol, 0.5 g/L glucose*1H2O, 2 mM MgSO4, 50 µg/mL kanamycin) with a fresh overnight culture. Cultures were grown at 37° C. up to an optical density at 600 nm of 0.6-0.8. Cultures were induced with 0.1 mM IPTG final concentration. Expression was at 24-25° C. overnight.

Preparation of TP enzyme preparations: Cells were harvested by centrifugation and suspended in 100 mM potassium phosphate-buffer pH 7, 2 mM MgCl2, 0.5 mg/mL lysozyme and 20 U/mL nuclease. Cells were disrupted by repeated freeze/thaw cycles. Cell free extract containing soluble enzyme was separated from the debris by centrifugation. The cell free extract was diluted 1:2 with 2 M sucrose solution.

Heat-inactivation and activity measurement: A 50 μL aliquot of each TP was incubated at 52° C. for 15 min. Denatured protein was separated by centrifugation. The activity of the supernatant was determined using Assay II with 500 mM glucose. Another aliquot of each TP was assayed directly for activity without heat-inactivation using Assay II with 500 mM glucose. The resulting residual activities are listed in Table 6. All variants showed a higher residual activity than the wild-type enzyme which means they possess an improved thermal stability compared to the wild-type.

TABLE 6

Residual activity of TP variants after incubation at 52° C. for 15 min

| SEQ ID | residual activity in % after 15 min incubation at 52° C. [%] |
|---|---|
| SEQ ID NO: 1 | 19 |
| SEQ ID NO: 2 | 30 |
| SEQ ID NO: 3 | 64 |
| SEQ ID NO: 4 | 30 |
| SEQ ID NO: 5 | 39 |
| SEQ ID NO: 6 | 54 |
| SEQ ID NO: 7 | 55 |
| SEQ ID NO: 8 | 42 |
| SEQ ID NO: 9 | 63 |
| SEQ ID NO: 10 | 68 |
| SEQ ID NO: 11 | 39 |
| SEQ ID NO: 12 | 55 |
| SEQ ID NO: 13 | 61 |
| SEQ ID NO: 14 | 30 |
| SEQ ID NO: 15 | 75 |
| SEQ ID NO: 16 | 43 |
| SEQ ID NO: 17 | 50 |
| SEQ ID NO: 18 | 41 |
| SEQ ID NO: 19 | 48 |
| SEQ ID NO: 20 | 75 |
| SEQ ID NO: 21 | 52 |
| SEQ ID NO: 22 | 37 |
| SEQ ID NO: 23 | 36 |
| SEQ ID NO: 24 | 47 |
| SEQ ID NO: 25 | 41 |
| SEQ ID NO: 26 | 45 |
| SEQ ID NO: 27 | 42 |
| SEQ ID NO: 28 | 31 |
| SEQ ID NO: 29 | 55 |
| SEQ ID NO: 30 | 38 |
| SEQ ID NO: 31 | 33 |
| SEQ ID NO: 32 | 39 |
| SEQ ID NO: 33 | 31 |
| SEQ ID NO: 34 | 53 |
| SEQ ID NO: 35 | 51 |
| SEQ ID NO: 36 | 34 |
| SEQ ID NO: 37 | 37 |
| SEQ ID NO: 38 | 39 |
| SEQ ID NO: 39 | 35 |
| SEQ ID NO: 40 | 46 |
| SEQ ID NO: 41 | 51 |
| SEQ ID NO: 42 | 43 |
| SEQ ID NO: 43 | 42 |
| SEQ ID NO: 44 | 55 |
| SEQ ID NO: 45 | 32 |
| SEQ ID NO: 46 | 43 |
| SEQ ID NO: 47 | 41 |
| SEQ ID NO: 48 | 35 |
| SEQ ID NO: 49 | 53 |
| SEQ ID NO: 50 | 96 |
| SEQ ID NO: 51 | 106 |
| SEQ ID NO: 52 | 99 |
| SEQ ID NO: 53 | 105 |
| SEQ ID NO: 54 | 105 |
| SEQ ID NO: 55 | 77 |
| SEQ ID NO: 56 | 106 |
| SEQ ID NO: 57 | 84 |
| SEQ ID NO: 58 | 88 |
| SEQ ID NO: 59 | 86 |
| SEQ ID NO: 60 | 113 |
| SEQ ID NO: 61 | 117 |
| SEQ ID NO: 62 | 101 |
| SEQ ID NO: 63 | 79 |
| SEQ ID NO: 64 | 101 |
| SEQ ID NO: 65 | 99 |
| SEQ ID NO: 66 | 105 |
| SEQ ID NO: 67 | 99 |
| SEQ ID NO: 68 | 92 |
| SEQ ID NO: 69 | 104 |
| SEQ ID NO: 70 | 76 |
| SEQ ID NO: 71 | 97 |
| SEQ ID NO: 72 | 90 |
| SEQ ID NO: 73 | 105 |
| SEQ ID NO: 74 | 108 |
| SEQ ID NO: 75 | 107 |
| SEQ ID NO: 76 | 97 |
| SEQ ID NO: 78 | 109 |
| SEQ ID NO: 79 | 97 |
| SEQ ID NO: 84 | 29 |
| SEQ ID NO: 85 | 23 |
| SEQ ID NO: 86 | 28 |
| SEQ ID NO: 87 | 38 |
| SEQ ID NO: 88 | 38 |
| SEQ ID NO: 89 | 42 |
| SEQ ID NO: 90 | 28 |
| SEQ ID NO: 91 | 40 |
| SEQ ID NO: 92 | 25 |
| SEQ ID NO: 93 | 35 |
| SEQ ID NO: 94 | 31 |
| SEQ ID NO: 95 | 35 |
| SEQ ID NO: 96 | 29 |
| SEQ ID NO: 97 | 38 |
| SEQ ID NO: 98 | 64 |
| SEQ ID NO: 99 | 22 |
| SEQ ID NO: 100 | 22 |
| SEQ ID NO: 101 | 54 |
| SEQ ID NO: 102 | 26 |
| SEQ ID NO: 103 | 41 |
| SEQ ID NO: 104 | 78 |
| SEQ ID NO: 105 | 33 |
| SEQ ID NO: 106 | 29 |
| SEQ ID NO: 107 | 30 |
| SEQ ID NO: 108 | 26 |
| SEQ ID NO: 109 | 33 |
| SEQ ID NO: 110 | 56 |
| SEQ ID NO: 111 | 43 |
| SEQ ID NO: 112 | 25 |
| SEQ ID NO: 113 | 63 |
| SEQ ID NO: 114 | 32 |
| SEQ ID NO: 115 | 72 |
| SEQ ID NO: 116 | 24 |
| SEQ ID NO: 117 | 37 |
| SEQ ID NO: 118 | 25 |
| SEQ ID NO: 119 | 32 |
| SEQ ID NO: 120 | 29 |
| SEQ ID NO: 121 | 72 |
| SEQ ID NO: 122 | 27 |
| SEQ ID NO: 123 | 32 |
| SEQ ID NO: 124 | 27 |
| SEQ ID NO: 125 | 55 |
| SEQ ID NO: 126 | 25 |
| SEQ ID NO: 127 | 23 |
| SEQ ID NO: 128 | 30 |
| SEQ ID NO: 129 | 23 |
| SEQ ID NO: 130 | 51 |
| SEQ ID NO: 131 | 31 |
| SEQ ID NO: 132 | 64 |
| SEQ ID NO: 133 | 67 |
| SEQ ID NO: 134 | 61 |
| SEQ ID NO: 135 | 59 |
| SEQ ID NO: 136 | 63 |
| SEQ ID NO: 137 | 56 |
| SEQ ID NO: 138 | 70 |
| SEQ ID NO: 139 | 62 |
| SEQ ID NO: 140 | 69 |
| SEQ ID NO: 141 | 62 |
| SEQ ID NO: 142 | 26 |

TABLE 6-continued

Residual activity of TP variants after incubation at 52° C. for 15 min

| SEQ ID NO: 143 | 28 |
| SEQ ID NO: 144 | 23 |
| SEQ ID NO: 145 | 29 |
| SEQ ID NO: 146 | 34 |
| SEQ ID NO: 147 | 55 |
| SEQ ID NO: 148 | 26 |
| SEQ ID NO: 149 | 43 |
| SEQ ID NO: 150 | 34 |
| SEQ ID NO: 151 | 40 |
| SEQ ID NO: 152 | 56 |
| SEQ ID NO: 153 | 26 |
| SEQ ID NO: 154 | 81 |
| SEQ ID NO: 155 | 68 |
| SEQ ID NO: 156 | 94 |
| SEQ ID NO: 157 | 69 |
| SEQ ID NO: 158 | 74 |
| SEQ ID NO: 159 | 87 |
| SEQ ID NO: 190 | 100 |

Example 4: 100/500-Ratio of TP Variants

Cell extract of TP-variants were prepared as described in Example 2. The activity was determined using Assay II with 500 mM glucose and Assay II with 100 mM glucose, respectively and the 100/500-ratio of each variant calculated. The resulting 100/500-ratios are listed in Table 7. As can be seen, some variants showed, in addition to an improved thermal stability, also a higher 100/500-ratio compared to the wild-type. This is an indication for an improved Km-value for glucose.

TABLE 7

100/500 ratio of TP variants

| SEQ ID | 100/500 ratio |
|---|---|
| SEQ ID NO: 1 | 0.6 |
| SEQ ID NO: 5 | 0.7 |
| SEQ ID NO: 6 | 0.8 |
| SEQ ID NO: 8 | 0.7 |
| SEQ ID NO: 22 | 0.7 |
| SEQ ID NO: 24 | 0.8 |
| SEQ ID NO: 26 | 0.7 |
| SEQ ID NO: 27 | 0.9 |
| SEQ ID NO: 29 | 0.7 |
| SEQ ID NO: 34 | 0.7 |
| SEQ ID NO: 36 | 0.7 |
| SEQ ID NO: 37 | 0.9 |
| SEQ ID NO: 38 | 0.8 |
| SEQ ID NO: 41 | 1.0 |
| SEQ ID NO: 42 | 0.8 |
| SEQ ID NO: 52 | 0.8 |
| SEQ ID NO: 53 | 0.9 |
| SEQ ID NO: 56 | 0.7 |
| SEQ ID NO: 57 | 0.9 |
| SEQ ID NO: 60 | 1.0 |
| SEQ ID NO: 61 | 1.0 |
| SEQ ID NO: 62 | 0.8 |
| SEQ ID NO: 63 | 0.9 |
| SEQ ID NO: 64 | 0.8 |
| SEQ ID NO: 65 | 0.8 |
| SEQ ID NO: 66 | 0.9 |
| SEQ ID NO: 68 | 0.7 |
| SEQ ID NO: 69 | 0.7 |
| SEQ ID NO: 75 | 0.9 |
| SEQ ID NO: 76 | 0.7 |
| SEQ ID NO: 190 | 0.9 |

Example 5: Denaturation Profiles of TP Variants

14 TP variants, which had shown high improvements in thermal stability in Example 3, were selected for the determination of their Tm30- and Tm50-values. Denaturation profiles were determined in 50 mM potassium phosphate buffer pH 7 containing 1 M sucrose as described in Example 2. The following Tm30- and Tm-50-values were extrapolated from the denaturation profiles:

TABLE 8

Tm30- and Tm50-values of TP-variants in 50 mM potassium phosphate buffer pH 7 containing 1M sucrose

| SEQ ID | Tm30 value | Tm50 value |
|---|---|---|
| SEQ ID NO: 1 | 49.5 | 47.5 |
| SEQ ID NO: 44 | 53.5 | 52 |
| SEQ ID NO: 50 | 54.5 | 53.5 |
| SEQ ID NO: 54 | 55.5 | 54.5 |
| SEQ ID NO: 57 | 55.5 | 54.5 |
| SEQ ID NO: 58 | 56 | 54.5 |
| SEQ ID NO: 62 | 57.5 | 56 |
| SEQ ID NO: 64 | 57.5 | 56 |
| SEQ ID NO: 65 | 57.5 | 56 |
| SEQ ID NO: 71 | 57 | 56 |
| SEQ ID NO: 72 | 58 | 56.5 |
| SEQ ID NO: 73 | 58.5 | 57.5 |
| SEQ ID NO: 74 | 57.5 | 56 |
| SEQ ID NO: 78 | 58 | 56 |
| SEQ ID NO: 79 | 57.5 | 56 |

Example 6: S/P-Ratio

The wild-type enzyme and 23 TP-variants were selected for the determination of the S/P-ratio. Cell extracts were prepared as described in Example 2. The activity was determined in the direction of trehalose phosphorolysis (Assay I) and trehalose synthesis (Assay II, 500 mM glucose). The ratio between synthesis and phosphorolysis activity (S/P-ratio) was 0.3 for the wild-type enzyme, which means that the enzyme shows higher reaction rates in the direction of trehalose cleavage. The tested TP variants all showed S/P-ratios above 0.3. SEQ ID NO: 42 and SEQ ID NO: 53 showed the highest improvements with an over 3-fold higher S/P-ratio compared to the wild-type enzyme.

TABLE 9

S/P-ratio

| SEQ ID | S/P-ratio |
|---|---|
| SEQ ID NO: 1 | 0.3 |
| SEQ ID NO: 14 | 0.5 |
| SEQ ID NO: 24 | 0.4 |
| SEQ ID NO: 27 | 0.5 |
| SEQ ID NO: 29 | 0.7 |
| SEQ ID NO: 34 | 0.6 |
| SEQ ID NO: 41 | 0.5 |
| SEQ ID NO: 42 | 0.9 |
| SEQ ID NO: 43 | 0.9 |
| SEQ ID NO: 44 | 0.5 |
| SEQ ID NO: 46 | 0.8 |
| SEQ ID NO: 50 | 0.6 |
| SEQ ID NO: 54 | 0.5 |
| SEQ ID NO: 57 | 0.4 |

TABLE 9-continued

| SEQ ID | S/P-ratio |
|---|---|
| SEQ ID NO: 58 | 0.5 |
| SEQ ID NO: 62 | 0.5 |
| SEQ ID NO: 64 | 0.5 |
| SEQ ID NO: 65 | 0.5 |
| SEQ ID NO: 71 | 0.5 |
| SEQ ID NO: 72 | 0.5 |
| SEQ ID NO: 73 | 0.6 |
| SEQ ID NO: 74 | 0.5 |
| SEQ ID NO: 78 | 0.5 |
| SEQ ID NO: 79 | 0.5 |

Example 7: Process Stability at 45° C.

Process stability of the wild-type enzyme and the TP variants SEQ ID NO: 14, SEQ ID NO: 44, SEQ ID NO: 62, SEQ ID NO: 64, SEQ ID NO: 65 and SEQ ID NO: 78 was determined at 45° C. in 50 mM potassium phosphate buffer pH 7 containing 1M sucrose. Cell extracts were prepared as described in Example 2. Samples were incubated at 45° C. for 16 days. Samples were taken over time and the activity was measured using Assay I. The results are shown in FIG. 2. SEQ ID NO: 1 showed a rapid activity loss within the first 3 hours and a half-life of approx. 1 hour. As expected from the Tm50-values, the new variants showed greatly improved process stability. SEQ ID NO: 62, SEQ ID NO: 65 and SEQ ID NO: 78 showed the highest improvements with half-lives of approx. 8.8 days. This constitutes an over 200-fold improvement compared to the wild-type enzyme.

Example 8: Alternative TP Enzymes

A possibility to identify alternative wild-type enzymes which possess trehalose phosphorylase activity is to compare known trehalose phosphorylases to sequences deposited in sequence databases, such as GenBank. In order to identify alternative TP enzymes, SEQ ID NO:1 was blasted against the non-redundant database of GenBank (NCBI). Alternative trehalose phosphorylases may be chosen from database sequences which either possess high sequence similarity to SEQ ID: 1, such as the putative trehalose phosphorylase from *Hypholoma sublateritium* FD-334 SS-4 (GenBank accession: KJA27491.1) or functionally characterized trehalose phosphorylases such as the enzymes from *Lentinus sajor-caju* (Genbank accession: Q9UV63.1), *Grifola frondosa* (Genbank accession: 075003.1 or ADM15725.1) or *Pleurotus ostreatus* (Genbank accession: KDQ33172.1). The sequences of these four enzymes were aligned to SEQ ID NO: 1 in FIG. 3.

Variants of alternative wild-type trehalose phosphorylases are created using the methods described in Example 1. The variants contain one or more mutations at the positions corresponding to L114, I118, G357, P383, N225, A304, T323, S556, T564, A649 and L712 in SEQ ID NO:1. Variants are tested for improved thermal stability as described in Example 3. The heat inactivation step is carried out at the temperature at which the corresponding wild-type retains approximately 20% residual activity after incubation for 15 min. It is expected, that the new variants will show similar improvements to the variants in Example 3. Further mutations corresponding to positions L114, I118, G357, P383, N225, A304, T323, F349, Q487, V550, S556, T564, A649 and L712 in SEQ ID NO:1 may be added. It is expected, that the addition of one or more of these mutations will lead to a further improvement in thermal stability.

TABLE 10

Residual activity after incubation at 52.5° C. for 15 min

| SEQ ID | residual activity in % after 15 min incubation at 52.5° C. [%] |
|---|---|
| SEQ ID NO: 160 | 9 |
| SEQ ID NO: 161 | 14 |
| SEQ ID NO: 162 | 22 |
| SEQ ID NO: 163 | 33 |
| SEQ ID NO: 164 | 26 |
| SEQ ID NO: 165 | 37 |
| SEQ ID NO: 166 | 37 |
| SEQ ID NO: 167 | 20 |
| SEQ ID NO: 168 | 34 |
| SEQ ID NO: 169 | 12 |
| SEQ ID NO: 170 | 15 |
| SEQ ID NO: 171 | 37 |
| SEQ ID NO: 172 | 29 |
| SEQ ID NO: 173 | 42 |
| SEQ ID NO: 174 | 12 |
| SEQ ID NO: 175 | 25 |
| SEQ ID NO: 176 | 57 |
| SEQ ID NO: 177 | 42 |
| SEQ ID NO: 178 | 56 |
| SEQ ID NO: 179 | 38 |
| SEQ ID NO: 180 | 74 |
| SEQ ID NO: 181 | 16 |
| SEQ ID NO: 182 | 28 |
| SEQ ID NO: 183 | 21 |
| SEQ ID NO: 184 | 43 |
| SEQ ID NO: 185 | 58 |
| SEQ ID NO: 186 | 42 |
| SEQ ID NO: 187 | 49 |
| SEQ ID NO: 188 | 70 |
| SEQ ID NO: 189 | 41 |

SEQUENCE LISTING (201 sequences)

SEQ ID NO: 1 - protein, 737 aa, Schizophyllum commune
  >SEQ ID NO:1
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 2 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPNGAWLNDLLREETGTPYVEGEPRLPRGGIKVQD

SEQ ID NO: 3 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMSGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 4 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPNGAWLNDMLREETGTPYVEGEPRLPRGGIKVQD

SEQ ID NO: 5 - protein, 737 aa, Artificial Sequence
  Synthetic trehalose phosphorylase based on wild-type S. Commune
MSPPHGFSSRPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQISRFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 6 - protein, 737 aa, Artificial Sequence
  Synthetic trehalose phosphorylase based on wild-type S. Commune
MSPPHGFSSRPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYFGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQISRFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 7 - protein, 737 aa, Artificial Sequence
  Synthetic trehalose phosphorylase based on wild-type S. Commune
MSPPHGFSSRPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYFGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 8 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYFGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQISRFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPNGAWLNDMLREETGTPYVEGEPRLPRGGIKVQD

SEQ ID NO: 9 - protein, 737 aa, Artificial Sequence
  Synthetic trehalose phosphorylase based on wild-type S. Commune
MSPPHGFSSRPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYFGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQISRFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPNGAWLNDMLREETGTPYVEGEPRLPRGGIKVQD

SEQ ID NO: 10 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 11 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRGYYMGEFRALCQADKMNTLDWPNREYCIQISRFDPSKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 12 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQISRFDPSKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 13 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNYDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGIFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 14 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 15 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGIFRALCQADKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 16 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGIFRALCQKDKMNTLDWPNREYCIQISRFDPSKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 17 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQADKMNTLDWPNREYCIQISRFDPSKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 18 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQADKMNTLDWPNREYCIQISRFDPSKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 19 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGIFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 20 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNYDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQADKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 21 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGIFRALCQKDKMNTLDWPNREYCIQISRFDPSKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 22 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLVAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 23 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTAGKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 24 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 25 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILHVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 26 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSHSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 27 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 28 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDIRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 29 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 30 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPASTDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 31 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGIFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 32 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRSLCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 33 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCVKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 34 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 35 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 36 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRELLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 37 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNVAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 38 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEARDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 39 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGGVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 40 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDAMDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 41 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 42 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 43 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 44 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 45 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLACLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 46 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 47 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDEMSQYARTHVSDEVGTVGNAAAWLYLAAVYTRGQKLAPKGAWLNDMLREETGTPYVEGEPRLPRGGIKVQD

SEQ ID NO: 48 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDKMSQYARTHVSDEVGTVGNAAAWLYLAAVYTRGQKLAPKGAWLNDMLREETGTPYVEGEPRLPRGGIKVQD

SEQ ID NO: 49 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLEPKGAWLNDMLREETGTPYVEGEPRLPRGGIKVQD

SEQ ID NO: 50 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDATIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 51 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 52 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 53 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 54 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDATIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 55 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 56 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 57 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 58 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 59 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 60 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 61 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 62 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 63 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 64 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 65 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 66 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 67 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 68 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 69 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 70 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDATIIYDQVLTLIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 71 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDATIIYDQVLTLIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 72 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 73 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNYDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 74 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 75 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 76 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 77 - protein, 737 aa, Artificial Sequence; identical to SEQ ID NO: 76
  Synthetic trehalose phosphorylase based on wild-type S. Commune

SEQ ID NO: 78 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 79 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCGKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 80 - protein, 696 aa, Hypholoma sublateritium FD-334 SS-4
  >KJA27491.1
MWAAVAGAVINNNTQYEIAVSIHDSVYSTDFASSVLSFNPNNPDKNAKEIEQYVLQTLRMFSVGHLCKFLGAGVTLLLLKESPNLCTRLWLDMDIVPFVFNIKPFHTDSLTRPNIKHRISSTTGSYVPSGADTPTVYVDSAHLTAMSGLQTGVSGRLPIPRTLDEQADSAARKCLMYFGPGNNPRLSIGPRNQVTVDSAGKAHLIDDIDEYKATVGPRTWNAVVKLADELREKKVKIGFFSSTPQGGGVALMRHALIRFLTALDVDAAWYVPNPSPSVFRTTKNNHNILQGVAAPDLRLTQEAKDNFDAWILKNGLRWTAEGGPLAPGGVDIAFIDDPQMPGLIPLIKKIRPDLPIVYRSHIEIRSDLVHVPGSPQEEVWKYLWNNIQLADLFISHPVNKFVPSDVPIEKLALLGAATDWLDGLNKELDPWDSQYYMGEFRNLCTKEKMHTLNWPERDYVVQIARFDPAKGINNVIDSYYKFRNMLKEKSPDLTEEEHPQLLLCGHGAVDDPDASIIYDQVLQLVESEPYKTYAKDIVVMRLPPSDQLLNALMANSRIALQLSTREGFEVKVSEALHAGKPVIASRTGGIPLQIEHGKSGYLTTAGDNAAVANHLYELYTDEALYRKMSQYAKTHVSDEVGTVGNAASWLYLAVMYHRGIKIKPNGAWLNDMLREETGEEYVEGEPRLPRGGLTMQ

SEQ ID NO: 81 - protein, 732 aa, Grifola frondosa
  ADM15725.1 trehalose synthase
MAPPHQFQSKPSDVIRRRLSSAVSSKRPNVPGYTSLTPMWAGIAGAVVNNNSQFEVAISIHDSVYNTDFASSIVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQVPGLIPLIKRIRPDLPIIYRSHIEIRSDLVHVKGSPQEEVWNYLWNNIQHSDLFISHPVNKFVPSDVPLEKLALLGAATDWLDGLSKHLDAWDAQYYMGEFRNLCIKEKMNELGWPARDYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRAGEPRLPRGELHVQG

SEQ ID NO: 82 - protein, 737 aa, Pleurotus ostreatus
  KDQ33172.1
MSTHHQFESKPSTAIRRRLSSSVSSKQRPNMTTTFASLTPMWAGVAGTLVNNNTQYEIAVTVHDGVYSTDFASVIIPVTPGDTAKNSKDIEAQVLNLIRKFSAEHLCKFLGAGITLALLKECPNLCTRLWLDMDIVPIVFNIKPFHTDSVTRPNIKHRISSTTGSYVPSGSETPTVYVEAAHLGDPSHLSPNAAQKLPIPRTLDEQSDSAARKCLMYFGPNNNPRLSIGARNQVTVDAGGKIHLIDDLEEYRKTVGTGTWNAVIKLADELREKKVKIGFFSSTPQGGGVALMRHALIRFLTALDVDVAWYVPNPSPQVFRTTKNNHNILQGVAAPDLRLTQDAKDAFDAWILKNGLRWTAEGGPLAPGGVDVVFIDDPQMPGLIPLIKKVRPEVPIVYRSHIEIRSDLVHVAGSPQEEVWKYLWNNIQLADLFISHPVSKFVPSDVPIEKLALLGAATDWLDGLNKDLDPWDSQFYMGEFRSLCAKEKMVELDWPTRDYIVQVARFDPSKGIPNVVDSYYKFRNLLRTRSPEMELSDHPQLLICGHGAVDDPDASIIYDQIMALVNSDPYKEYAHDIVVMRLPPSDELLNAMMANSRIALQLSTREGFEVKVSEALHTGKPVIACRTGGIPLQIQHGKSGYLTTPGDNDAVAGYLYDLYTDEALYRRMSDFARTHVSDEVGTVGNAAAWLYLAVMYSRGEKIKPNGAWINDLLREETGEPYKEGETKLPRTKLDMQG

SEQ ID NO: 83 - protein, 751 aa, Lentinus sajor-caju
  Q9UV63.1
MSTPHHQFESKSSTAIRRRLSSSVSSKQRPNIMTTTFASLTPMWAGVAGTLVNNNTQYEIAVTVHDGVYSTDFASVIIPVTPGDTVKNSKDIEAQVLNLIRKFSAEHLCKFLGAGITLALLKECPNLCTRLWLDMDIVPIVFNIKPFHTDSVTRPNIKHRISSTTGSYVPSGSETPTVYVEASHLGDPSHLSPNAAQKLPIPRTLDEQSDSAARKCLMYFGPNNNPRLSIGARNPVTVDAGGKIHLIDDLEEYRMTVGAGTWNAVIKLADELREKKVKIGFFSSTPQGGGVALMRHALIRFLTALDVDVAWYVPNPSPQVFRTTKNNHNILQGVAAPDLRLTQEAKDAFDAWILKNGLRWTAEGGPLAPGGVDVVFIDDPQMPGLIPLIKKVRPEVPIVYRSHIEIRNDLVHVAWSPQEEVWKYLWNNIQLADLFISHPVSKFVPSDVPTEKLALLGAATDWLDGLNKDLDPWDSPFYMGEFRPRGSHLNRGEFRSLCAKEKMHELNWPARDYIVQVARFDPSKGIPNVVDSYYKFRNLLRTRSPDMDESEHPQLLICGHGAVDDPDASIIYDQIMALVNSDPYKEYAHDIVVMRLPPSDELLNAMMANSRIALQLSTREGFEVKVSEALHTGKPVIACRTGGIPLQIQHGKSGYLTTPGEKDAVAGHFYDFYTDEALYRKMSDFARTHVSNEVGTVGNAAAWLYLAVMYSRGEKIKPNGAWINDFFREETGEPYKEGETKLPRTKLDMQG

SEQ ID NO: 84 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 85 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 86 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 87 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 88 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 89 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 90 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 91 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 92 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNIPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 93 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNLPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 94 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNMPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 95 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSLLDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 96 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRVTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 97 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMAGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 98 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMGGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 99 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMMGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 100 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMNGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 101 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMCGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 102 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMQGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 103 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMSGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 104 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMTGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 105 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCGKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 106 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 107 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCMKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 108 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAPDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 109 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLGCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 110 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 111 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 112 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 113 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 114 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 115 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 116 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 117 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 118 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 119 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 120 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 121 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 122 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 123 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 124 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 125 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 126 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNALRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 127 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 128 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 129 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 130 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 131 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 132 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNYDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 133 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNYDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 134 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 135 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNALRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 136 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 137 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 138 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 139 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 140 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 141 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 142 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 143 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 144 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 145 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAIDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 146 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 147 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 148 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDATIIYDQVLTLIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 149 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 150 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLELIHEKYAEFAKDIVVMRLPPSDQLLDCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 151 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 152 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLNCLMANARIALQLSTREGFEVKVSEAVHAGKPIIAATTGGIPLQVEHGKSGFLTEPGDNAQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 153 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVDADDQPQLLICGHGAVDDPDASIIYDQVLTLIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 154 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 155 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 156 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNGLRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 157 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 158 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLDCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 159 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCAKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 160 - protein, 732 aa, Grifola frondosa
  SEQ ID NO: 160
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 161 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 162 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGITVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 163 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNVPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 164 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTILDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 165 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRITKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 166 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 167 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDATIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 168 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLELIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 169 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNEAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 170 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDMMRTEMGEPYRPGEPRLPRGELHVQG

SEQ ID NO: 171 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNVPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 172 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTILDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 173 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRITKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 174 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCAKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 175 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDATIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 176 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFIGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 177 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGITVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 178 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNVPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 179 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTILDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 180 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRITKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 181 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNYDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 182 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCAKEKMNELGWPAREYIVQIARFDPSKGIPNVIDSYARFRKLCVDKVMEDDIPQLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 183 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAIDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 184 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDATIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 185 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCAKEKMNELGWPAREYIVQIARFDPSKGIPNVIDSYARFRKLCVDKVMEDDIPQLLLCGHGAVDDPDASIIYDQVLELIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 186 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAIDDPDATIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 187 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAIDDPDASIIYDQVLELIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 188 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCVKEKMNELGWPAREYIVQIARFDPSKGIPNVIDSYARFRKLCVDKVMEDDIPQLLLCGHGAVDDPDATIIYDQVLELIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 189 - protein, 732 aa, Artificial Sequence
  Synthetic trehalose phosphorylase based on wild-type G. Frondosa
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTALDVDAAWYVPNPSPSVFRTTKNNHNILQGVADPSLRLTKEAADNFDSWILKNGLRWTAEGGPLAPGGVDIAFIDDPQMVGLIPLIKRIRPDLPIIYRSHIEIRSDLVHVKGSPQEEVWNYLWNNIQHSDLFISHPVNKFVPSDVPLEKLALLGAATDWLDGLSKHLDAWDSQYYMGEFRNLCAKEKMNELGWPAREYIVQIARFDPSKGIPNVIDSYARFRKLCVDKVMEDDIPQLLLCGHGAIDDPDASIIYDQVLELIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRPGEPRLPRGELHVQG

SEQ ID NO: 190 - protein, 737 aa, Artificial Sequence
  Synthetic trehalose phosphorylase based on wild-type S. Commune
MSPPHGFSSVPSTAARRRLSSKASLTNRPTFTKITTQTYASLTPMWAGIAGAPINNGSQFELAISVHDSVYSTDFASFVIDHTPLDPEKAAKEIEKHVLDALRKFSQEHLCKFIGAGVTLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNVPRLTIGPRNQVAVDAGGKIHLIDDIDEYRKTVGPSTWTAVNKLADELRERQIKIGFFSSTPQGGGVALMRHALIRFFSILDVDAAWYVPNPSPSVFRITKNNHNILQGVASPDLRLTQEAKDNFDAWITKNALRWTAEGGPLAPGGVDIAFIDDPQMVGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCLKDKMNTLDWPNREYCIQIARFDPAKGIPNVIDSYARFRRLLNEAGDVDADDQPQLLICGHGAIDDPDATIIYDQVLELIHEKYAEFAKDIVVMRLPPSDQLLNCLMANARIALQLSTREGFEVKVSEAVHAGKPIIAATTGGIPLQVEHGKSGFLTEPGDNEQVARHMYDLYTDVALYDRMSQYARTHVSDEVGTVGNAAAWLYLAAVYTRGQKLAPKGAWLNDMLREETGTPYVEGEPRLPRGGIKVQD

SEQ ID NO: 191 - protein, 737 aa, Schizophyllum commune H4-8
  >XP_003035156.1 glycosyltransferase family 4 protein [Schizophyllum commune H4-8] >EFJ00254.1 glycosyltransferase family 4 protein [Schizophyllum commune H4-8]
MSPPHGFSSKPSTAARRRLSSKASLTNRPTFSKITTQTYASLTPMWAGIAGAPINNGSQFELAISVHDSVYSTDFASFVIDHTPLDPEKAAKEIEKHVLDALRKFSQEHLCKFLGAGITLALLRESPNICTRLWLDLDIVPIVFNIKPFHTDSLTRPNIKHRISSTSGSYVPSGAETPTVYVEASHLGNNLSAGTASKLPIPRTLDEQADSAARKAIMYYGPNNNPRLTIGPRNQVAVDAGGKIHLIDDIDEYRKTVGPSTWTAVNKLADELRERQIKIGFFSSTPQGGGVALMRHALIRFFSALDVDAAWYVPNPSPSVFRTTKNNHNILQGVASPDLRLTQEAKDNFDAWITKNGLRWTAEGGPLAPGGVDVAFIDDPQMPGLIPLIKKVRPELPIIYRSHIEIRSDLVHIAGSPQEEVWKYLWNNIQLADLFISHPVKAFVPEDVPIERVALLPAATDWLDGLNKELSDWDRQYYMGEFRALCQKDKMNTLDWPNREYCIQIARFDPAKGIPNVIDSYARFRRLLNEAGDVEPDDQPQLLICGHGAVDDPDASIIYDQVLTLIHEKYAEFAKDIVVMRLPPSDQLLDCLMANARIALQLSTREGFEVKVSEAIHAGKPIIAATTGGIPLQVEHGKSGFLTEPGDNVQVARHMYDLYTDVALYDRMSQYARTHVSDEVGTVGNAAAWLYLAAVYTRGQKLAPKGAWLNDLLREETGTPYVEGEPRLPRGGIKVQD

SEQ ID NO: 192 - protein, 626 aa, Trametes cinnabarina
  >CDO74881.1 Glycosyltransferase Family 4 protein [Trametes cinnabarina]
MPAIGSRQANLAQAPNLCTRLWLELDIVPIVFNIKPYHTDSITRPNIRHRISSTTGSYVPSGAETPTVYYDPSQLPGAQANLTATQNKLPIPRTVDEQADSAARKCIMYFGPSNNPRLTIGPRNQVAVDAGGKIHLIDDIDEYRKGVGKGTWNCVNKLADELREKKIKMAFFSSTPQGGGVALMRHALIRFLNLLDVDCAWYVPNPSPTVFRTTKNNHNILQGVADPNLRLTKEAKDNFDAWILKNGLRWTAEGGPLAPGGVDIAFIDDPQMPGLIPLIRRVRPDLPIIYRSHIEIRSDLVHVAGSPQEEVWKYLWNNIQHADMFISHPVNKFVPSDVPTDKLALLGAATDWLDGLNKPLDQWDLQYYMGEFRSLCVKEKMTELGWPAREYIVQIARFDPSKGIPNVIDSYARFRKLLAEKEPDIEPPQMLICGHGAVDDPDASIIYDQTMQLIHNKYAQYAGDFVVMRCPPSDQLLNALMENSKFALQLSTREGFEVKVSEALHAGKPVIASRTGGIPLQIEHGKSGYLCEPGDNAAVAQHMFDLYTDDDLFDQMSEYARTHVSDEVSTVGNATAWMYLAVMYCSRGVRLQPNGAWLNDLMRTECGEPYQPGEPRLPRGGLNVQG

SEQ ID NO: 193 - protein, 735 aa, Hypsizygus marmoreus
  >KYQ39707.1 Trehalose phosphorylase [Hypsizygus marmoreus]
MAPYHQFESKPSLAMRRRLSSSVSTRPEVTATFASLTPMWAGIAGNPISNNTHYEIAISIHDSVYSTDFSSTVISYFPDEPEKTAKSIQAHVLETLRKFSKEHLCKFLGAGVTLSLLREAPNLCTRLWLDMDIVPIVFNIKPYHTDSITRPNIKHRISSTTGSYVPSGAETPTVYIDSAQLTAAGLLPTGLSDRLPIPRTLDEQADSAARKCIMYFGPNNNPRLSIGPRNQVTVDAAGKIHLIDDLDEYKKTVGPGTWNAVVKLADELREKKVKIGFFSSTPQGGGVALMRHALIRFLTALDVDAAWYVPNPSPSVFRTTKNNHNILQGVAPPDLRLTKEAKENFDAWILKNGLRWTAEGGPLAPGGVDIAFIDDPQMPGLIPLIKRVRPGMPIVYRSHIEIRSDLVHVPGSPQEEVWKYLWNNIKLADLFISHPVSKFVPSDVPEAKLALLGAATDWLDGLNKHLDPWDAQFYMGEFRSLCAKEKMNELQWPQRDYVIQVARFDPAKGIPNVIDSYCKFRHLLTQPPVLTSDEYPQLLICGHGAVDDPDASIIYDQVMQLINSEKYAEYAQDIVVMRLPPSDQLLNALMANARIALQLSTREGFEVKVSEAVHAGIPVIASQTGGIPLQVEHGKSGYLTAPGDNAAVAQHLYELYTDEGLYRRISAYAKTHVSDEVGTVGNAAAWLYLAVMYHRGVKIRPQGAWLNDMLREETGEAYVEGEPRLPRGGLVVQGN

SEQ ID NO: 194 - protein, 735 aa, Trametes versicolor
  >XP_008036133.1 trehalose synthase [Trametes versicolor FP-101664 SS1] >EIW60750.1 trehalose synthase [Trametes versicolor FP-101664 SS1]
MAPSSPHHQFQSKTSDAIRRRLSSVVSSKRPNVQAYSSLTPMWAGIAGTVINNNTALELAISIHDSVYNTDFASSTVPYNPNNPEEQASNVEKHVLELLRKFATEHMCKFLGAGVTVSLLREAPNLCTRLWFDLDIVPIVFNIKPFHTDSVTRPNIKHRISSTTGSYVPSGAETPTVYYDPAQLPAGQANVTATQNKLPIPRTVDEQADSAARKCIMYFGPGNNPRLSIGARNQVTVDAGGKIHLIDDIDEYRKGNSKGTWNSVIKLADELREKKIKIGFFSSTPQGGGVALMRHALIRFLNLLDVDAAWYVPNPSPSVFRTTKNNHNILQGVADPNLRLSKEAKDNFDAWILKNGLRWTAEGGPLAPGGVDIAFIDDPQMPGLIPLIKRVRPDLPIIYRSHIEIRSDLVHVAGSPQEEVWKYLWNNIQHADLFISHPVNKFVPSDVPPEKLTLLGAATDWLDGLNKPLGDWDLQYYMGEFRQLCVKEKMNELGWPLRDYIVQIARFDPSKGIPNVIDSYARFRKLLAEKEPATEPPQMLICGHGAVDDPDASIIYDETMQLIHTKYAEYAKDFVVMRCPPSDQLLNALMENSKFALQLSTREGFEVKVSEALHAGKPVIASRTGGIPLQIEHGKSGYLCEPGDNAAVASHMFDLYTDDDLFDTMSEYARTHVSDEVGTVGNAAAWMYLAVMYCSRGVRLQPKGAWLNDLMRTECGEPYAPNEPRLPRAGLNVQG

SEQ ID NO: 195 - protein, 739 aa, Pleurotus pulmonarius
  >A6YRN9.1 RecName: Full=Trehalose phosphorylase; AltName: Full=Trehalose synthase; Short=TSase; Flags: Precursor >ABR88135.1 trehalose phosphorylase [Pleurotus pulmonarius]
MSTPHHQFESKSSTAIRRRLSSSVSSKQRPNIMTTTFASLTPMWAGVAGTLVNNNTQYEIAVTVHDGVYSTDFASVIIPVTPGDTVKNSKDIEAQVLNLIRKFSAEHLCKFLGAGITLALLKECPNLCTRLWLDMDIVPIVFNIKPFHTDSVTRPNIKHRISSTTGSYVPSGSETPTVYVEASHLDDPSHLSPNAAQKLPIPRTLDEQSDSAARKCLMYFGPNNNPRLSIGARNQVTVDAGGKIHLIDDLEEYRETVGAGTWNAVIKLADELREKKVKIGFFSSTPQGGGVALMRHALIRFLTALDVDVAWYVPNPSPQVFRTTKNNHNILQGVAAPDLRLTQEAKDAFDAWILKNGLRWTAEGGPLAPGGVDVVFIDDPQMPGLIPLIKKVRPEVPIVYRSHIEIRSDLVHVAGSPQEEVWKYLWNNIQLADLFISHPVSKFVPSDVPTEKLALLGAATDWLDGLNKDLDPWDSQFYMGEFRSPCAKEKMHELNWPARDYIVQVARFDPSKGIPNVVDSYYKFRNLLRTRSPDMDESEHPQLLICGHGAVDDPDASIIYDQIMALVNSDPYKEYAHDIVVMRLPPSDELLNAMMANSRIALQLSTREGFEVKVSEALHTGKPVIACRTGGIPLQIQHGKSGYLTTPGDNDAVAGHLYDLYTDEALYRKMSDFARTHVSDEVGTVGNAAAWLYLAVMYSRGEKIKPNGAWINDLLREETGEPYKEGETKLPRTKLDMQG

SEQ ID NO: 196 - protein, 737 aa, Agaricus bisporus
  >XP_006458503.1 hypothetical protein AGABI2DRAFT_190782 [Agaricus bisporus var. bisporus H97] >EKV50461.1 hypothetical protein AGABI2DRAFT_190782 [Agaricus bisporus var. bisporus H97]
MAHTAHPFSSVPSAAVRRRLSSSVSAKKPLVTATFSSLTPMWAGVAGVIINNNTEFEVAVSVHDSVYSTDFASVVLPYDPNDPEKNAKTIEQYILQVLRRFSVEHLCKFLGAGVTLTLLREVPNVCTRLWLDLDIVPFVFNIKQYHTDSLTRPNIKHRISSTTGSYVPSGAETPTVYVDSAHLKAMSGLQTGVSGRLPIQRTLDEQADSAARKCLMNFGPGNNPRLNIGPRNQVLVDDGGRVHLLDDLDEYRNTVGPRTWNAVIKLADELREKKVKIGFFSSTPQGGGVALMRHALIRFLTALDVDAAWYVPNPSPAVFRTTKNNHNILQGVAAPDLRLTEEARDAFDAWILKNGLRWTAEGGPLARGGVDVAFIDDPQMPGLIPLIKKIRPELPIVYRSHIEIRSDLVHVPGSPQEEVWKYLWKNIQLADLFISHPVSKFVPQDVPLEKVALLGAATDWLDGLNKDLDPWDSQYYMGEFRALCARERMLELRWPQRDYIIQVARFDPSKGIPNVIDSYVKFRELLKLKSPELDDEDHPQLLVCGHGAVDDPDASIIYDQIMQIINSEQYEAYAKDIVVMRLPPSDQLLNSLMSNAKIALQLSTREGFEVKVSEALHTGKPVIASRTGGIPLQIEHGKSGYLCTPGDNEAVAGHLYDLYTDEILYKTMSDYAKTHVSDEVGTVGNTAAWLYLAVMYNRGIKIKPNGAWLNDLLRTETGEDYEEGEPRLPRGGLKMQG

SEQ ID NO: 197 - protein, 737 aa, Agaricus bisporus
  >XP_007326883.1 hypothetical protein AGABI1DRAFT_111552 [Agaricus bisporus var. burnettii JB137-S8] >EKM83027.1 hypothetical protein AGABI1DRAFT_111552 [Agaricus bisporus var. burnettii JB137-S8]
MAHTAHPFYSVPSAAVRRRLSSSVSAKKPLVTATFSSLTPMWAGVAGVIINNNTEFEVAVSVHDSVYSTDFASVVLPYDPNDPEKNAKTIEQYILQVLRRFSVEHLCKFLGAGVTLTLLREVPNVCTRLWLDLDIVPFVFNIKQYHTDSLTRPNIKHRLSSATGSYVASGAETPTVYVDSAHLKAMSGLQTGVSGRLPIQRTLDEQADSAARKCLMNFGPGNNPRLNIGPRNQVLVDDGGRVHLLDDLDEYRNTVGPRTWNAVIKLADELREKKVKIGFFSSTPQGGGVALMRHALIRFLTALDVDAAWYVPNPSPAVFRTTKNNHNILQGVAAPDLRLTEEARDAFDAWILKNGLRWTAEGGPLARGGVDVAFIDDPQMPGLIPLIKKIRPELPIVYRSHIEIRSDLVHVPGSPQEEVWKYLWKNIQLADLFISHPVSKFVPQDVPLEKVALLGAATDWLDGLNKDLDPWDSQYYMGEFRALCARERMLELRWPQRDYIIQVARFDPSKGIPNVIDSYVKFRELLKLKSPELEDEDHPQLLVCGHGAVDDPDASIIYDQIMQIVNSEPYEAYAKDIVVMRLPPSDQLLNSLMSNAKIALQLSTREGFEVKVSEALHTGKPVIASRTGGIPLQIEHGKSGYLCTPGDNEAVAGHLYDLYTDEILYKTMSDYAKTHVSDEVGTVGNTAAWLYLAVMYNRGIKIKPNGAWLNDLLRTETGEDYEEGEPRLPRGGLKMQG

SEQ ID NO: 198 - protein, 733 aa, Laetiporus sulphureus
  >KZT11205.1 glycosyltransferase family 4 protein [Laetiporus sulphureus 93-53]
MAPPHSFTSKPSVATRRRLSSVVTPNRPNVPGFTSLTPMWAGIAGTIINDNTAFEVAISIHDSVYCTDFASSVVPYDATDPEKQSVAIEKHVLDTLRKFSNEHLCKFLGAGVTLSLLREAPNLCTRLWLEMDIVPIVFNIKPYHTDSITRPNVKHRISSTTGSYVPSGAETPTVYVDASQLQDQSKLTTGAQQRLPIPRTVDEQADSAARKCIMYFGPGNNPRLSIAPRNQVAVDSGGKIHLIDDLDEYRKTVHKGTWNAVIKLADELREKKIRFAFFSSTPQGGGVALMRHALIRFFQALDVDAAWYVPNPSPSVFRTTKNNHNILQGVADPSLRLTQDQKENFDAWILKNGLRWTAEGGPLAKGGVDIAFIVDDPQMPGLIPLIKRVRPDMPIVYRSHIEIRSDLVSVAGSPQEEVWKYLWNNIQYADMFISHPVNKFVPTDVPLEKLALLGAATDWLDGLNKHLHPWDTQYYMGEFRQLCAREKMHELLWPVRDYVVQIARFDPSKGIPNVIDSYARFRRMMKSNAPNEDPPQLLVCGHGAVDDPDASIIYDQIIALVTGPYKEYEQDMIVMRCPPSDQLLNVLMANSRVALQLSTREGFEVKVSEALHAGKPVIASRTGGIPLQIEHGKSGFLCDAGDNEAVAKHMFDLITNEDLYEEMSEYARTHVSDEVGTVGNAAAWMYLAVMYCSRGVKLQPKGAWVNDMMREETGEPYEPGEPRLPRGHIHVQG

SEQ ID NO: 199 - protein, 736 aa, Gloeophyllum trabeum
  >XP_007863746.1 trehalose synthase [Gloeophyllum trabeum ATCC 11539] >EPQ58616.1 trehalose synthase [Gloeophyllum trabeum ATCC 11539]
MSPTQHFQSKPPDSYRRRLSSVISRRRPNVPQFSSLQAMWAGIAGGVVNNNTQFEIAISIHDSVYATDYASMQIPYSPNGDNGDKIEQQILSTLRKFSADHLCKFLGAGVTLSLLKEAPNLCTRLWLTLDIVPIVFNIKPYHTDSVTRPNIKHRLYSQTGSFAPSGADTPTVYVDPTPLAKNNVLAPGTAANLGTPTTKGLPIPRTMDEQADSAARKCIMYFGPGNNPRLSIGPRNQVLVDSAGKIHLIDDLDEYRKTVSSGTWNAVNKLADELREKKIKIGFFSSTPQGGGVALMRHALIRFLTLLDVDASWYVPNPSPSVFRTTKNNHNILQGVAAPSLRLTQDQKDNFDAWIQKNGLRWTAEGGPLAQGGVDIAFIDDPQMPGLIPLIKQVRPDMPIIYRSHIEIRSDLVHVKGSPQEEVWNYLWKNIQLADMFISHPVKKFVPSDVPTEKLAFLGAATDWLDGLNKPLDTWDSQYYMGEFRSLCVREKMHELKWPAREYVVQIARFDPSKGIPNVIDSYAKFRKMLAEKTELEEDIMPQLLICGHGAVDDPDASIIYDQVTGLIHSQYSQYSNDIIVMRLPPSDQLLNALMDNAKIALQLSTREGFEVKVSEALHTGKPVVASRTGGIPLQIEHGKSGYLVEVGDNETVAKHLFDLYTDEKLYDTMSEYARTHVSDEVGTVGNAAAWLYLAMMYCSRGEKVKPNGAWLNDLMREVTGEPYAPDEPKLPRVVN

SEQ ID NO: 200 - protein, 693 aa, Grifola frondosa
  >OBZ75413.1 Trehalose phosphorylase [Grifola frondosa]
MAPPHQFQSKPSDVIRRRLSSAVSSKRPNIPGYTSLTPMWAGIAGAVVNNNTQFEVAISIHDSVYNTDFASSVVPYSPNEPEAQAGIIEKHVLETLRKFSTEHMCKFLGAGVTVILLREAPNLCTRLWLDMDIVPIVFNIKPFHTDSITRPNVRHRISSTTGSYVPSGAETPTVYYDPAQLQDPNKLSANVQTRLPIPRTVDEQADSAARKCIMYFGPGNNPRLQIGPRNQVAVDAGGKIHLIDDIDEYRKTVGKGTWNSVIKLADELREKKIKIGFFSSTPQGGGVALMRHAIIRFFTVLDVDAAWYVPNPSPSVFRTTKNNHNILQGVADPSLRLTKEAADNFDSWILKNGLRWTAEGGPLAPGGVDIAFIDDPQMPGLIPLIKRIRPDLPIIYRSHIEIRSDLVHVKGSPQEEVWNYLWNNIQHSDLFISHPVNKFVPSDVPLEKLALLGAATDWLDGLSKHLDAWDAQYYMGSSATYRSLRPVQGYPERDRLLLLCGHGAVDDPDASIIYDQVLQLIHAKYKEYAPDIVVMRCPPSDQLLNTLMANAKFALQLSTREGFEVKVSEALHAGKPVIACRTGGIPLQIEHGKSGYLCEPGDNAAVAQHMLDLYTDEDLYDTMSEYARTHVSDEVGTVGNAAAWMYLAVMYVSRGVKLRPHGAWINDLMRTEMGEPYRAGEPRLPRGELHVQG

SEQ ID NO: 201 - protein, 650 aa, Trametes pubescens
  >OJT04097.1 Trehalose phosphorylase [Trametes pubescens]
MWAGIAGTVINNNTALELAISIHDSVYNTDFASSTVPYNPNNPEEQASNVEKHVLELLRKFATEHMCKFLGAGVTVSLLREAPNLCTRLWFDLDIVPIVFNIKPFHTDSVTRPNIKHRISSTTGSYVPSGAETPTVYYDPAQLPAGQANVAATQNKLPIPRTVDEQADSAARKCIMYFGPGNNPRLSIGARNQVTVDAGGKIHLIDDIDEYRKGNSKGTWNSVIKLADELREKKIKIGFFSSTPQGGVADPNLRLSKEAKDNFDAWILKNGLRWTAEGGPLAPGGVDIAFIDDPQMPGLIPLIKRVRPDLPIIYRSHIEIRSDLVHVAGSPQEEVWKYLWNNIQHADLFISHPVNKFVPSDVPPEKLTLLGAATDWLDGLNKPLGDWDLQYYMGEFRQLCVKEKMTELGWPLRDYIVQIARFDPSKGIPNVIDSYARFRKLLAEKEPGTEPPQMLICGHGAVDDPDASIIYDETMQLIHTKYAEYAKDFVVMRCPPSDQLLNALMENSKFALQLSTREGFEVKVSEALHAGKPVIASRTGGIPLQIEHGKSGYLCEPGDNAAVASHMFDLYTDDDLFDTMSEYARTHVSDEVGTVGNAAAWMYLAVMYVSRGVRLQPKGAWLNDLMRTECGEPYAPNEPRLPRAGLNVQG

The invention claimed is:
1. A trehalose phosphorylase comprising an amino acid sequence, wherein the amino acid sequence of the trehalose phosphorylase is at least 80% identical to and/or at least 80% homologous to an amino acid sequence of SEQ ID NO: 1, wherein the amino acid sequence of the trehalose phosphorylase comprises an amino acid substitution at one or more amino acid positions, wherein
   (a) the one or more amino acid positions is/are selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1,
   (b) when the amino acid substitution comprises a substitution at amino acid position 649, then the amino acid substitution at position 649 is selected from the group consisting of the substitutions 649D and 649E, and
   (c) when the amino acid substitution comprises a substitution at amino acid position 10, then the amino acid substitution at position 10 is selected from the group consisting of the substitutions V10R and V10H.

2. The trehalose phosphorylase of claim 1, wherein the one or more amino acid positions is/are selected from the group consisting of amino acid positions 712, 383, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 667, 703 and 705 of SEQ ID NO: 1.

3. The trehalose phosphorylase of claim 1, wherein the one or more amino acid positions is/are selected from the group consisting of amino acid positions 383, 225, 304, 323, 487, 550, 556, 564, 590, and 705 of SEQ ID NO: 1.

4. The trehalose phosphorylase of claim 1, wherein the one or more amino acid positions is at amino acid position 383 of SEQ ID NO: 1.

5. The trehalose phosphorylase of claim 1, wherein the one or more amino acid positions is/are selected from the group consisting of amino acid positions L712M, P383G, P383V, P383C, P383S, P383T, V10R, L14I, I118V, S192V, S197G, Y220F, N225I, N225L, N225M, N225V, A304L, A304I, D306H, P318H, T323I, T323V, L339I, F349Y, G357A, A459S, Q476G, E481I, A484S, 487A, Q487G, Q487L, Q487M, Q487V, K488A, A506S, A511S, R526E, E530V, G532R, D533G, D537M, V550I, V550P, S556T, T564E, D590N, D590G, D590A, A649E, R667E, R667K, A703E, and K705N of SEQ ID NO: 1.

6. The trehalose phosphorylase of claim 1, wherein the one or more amino acid positions is/are selected from the group consisting of amino acid positions P383G, P383V, P383C, P383S, P383T, V10R, L14I, S192V, S197G, N225I, N225L, N225M, N225V, A304L, A304I, D306H, P318H, T323I, T323V, L339I, F349Y, G357A, A459S, Q476G, E481I, A484SQ487G, Q487L, Q487M, Q487V, K488A, A506S, A511S, R526E, E530V, G532R, D533G, D537M, V550I, V550P, S556T, T564E, D590G, D590A, A649E, R667E, R667K, A703E, and K705N of SEQ ID NO: 1.

7. The trehalose phosphorylase of claim 1, wherein the trehalose phosphorylase comprises an amino acid substitution at two or more amino acid positions, wherein the two or more amino acid positions are selected from the group consisting of 10 and 114, 10 and 712, 114 and 118, 114 and 304, 114 and 357, 114 and 383, 114 and 590,114 and 712, 118 and 304, 118 and 357, 118 and 383, 118 and 556, 118 and 564, 118 and 590, 118 and 712, 225 and 304, 225 and 383, 225 and 487, 225 and 550, 225 and 556, 225 and 590, 304 and 323, 304 and 357, 304 and 383, 304 and 487, 304 and 556, 304 and 564, 304 and 590, 304 and 712, 323 and 357, 323 and 487, 323 and 556, 323 and 564, 323 and 590, 323 and 649, 349 and 383, 349 and 590, 357 and 383, 357 and 590, 357 and 705, 357 and 712, 383 and 487, 383 and 550, 383 and 556, 383 and 564, 383 and 590, 383 and 649, 383 and 712, 487 and 564, 487 and 590, 487 and 649, 550 and 590, 556 and 564, 556 and 590, 556 and 649, 564 and 590, 564 and 712, 590 and 649, 590 and 712, and 649 and 712.

8. The trehalose phosphorylase of claim 1, wherein the trehalose phosphorylase comprises an amino acid substitution at two or more amino acid positions, wherein the two or more amino acid positions are selected from the group consisting of 118 and 383, 118 and 556, 118 and 564, 118 and 590, 225 and 304, 225 and 383, 225 and 487, 225 and 550, 225 and 556, 225 and 590, 304 and 323, 304 and 383, 304 and 487, 304 and 556, 304 and 564, 304 and 590, 323 and 357, 323 and 487, 323 and 556, 323 and 564, 323 and 590, 323 and 649, 349 and 383, 349 and 590, 357 and 383, 357 and 590, 383 and 487, 383 and 550, 383 and 556, 383 and 564, 383 and 590, 383 and 649, 383 and 712, 487 and 564, 487 and 590, 487 and 649, 550 and 590, 556 and 564, 556 and 590, 556 and 649, 564 and 590, 564 and 712, 590 and 649, 590 and 712, 649 and 712, and 705 and 712.

9. The trehalose phosphorylase of claim 1, wherein the trehalose phosphorylase comprises an amino acid substitution at two or more amino acid positions, wherein the two or more amino acid positions are selected from the group consisting of 118 and 383, 118 and 590, 225 and 383, 225 and 590, 304 and 383, 304 and 590, 323 and 590, 349 and 383, 349 and 590, 357 and 383, 357 and 590, 383 and 487, 383 and 550, 383 and 556, 383 and 564, 383 and 590, 383 and 649, 383 and 712, 487 and 590, 550 and 590, 556 and 590, 564 and 590, 590 and 649, 590 and 712.

10. The trehalose phosphorylase of claim 1, wherein the amino acid sequence of the trehalose phosphorylase comprises one or more substitutions, wherein the one or more substitution is/are selected from the group consisting of
    an amino acid substitution at position 712 of SEQ ID NO: 1 with the substitution being L712A, L712G, L712, L712M, L712P or L712V;
    an amino acid substitution at position 383 of SEQ ID NO: 1 with the substitution being P383A, P383G, P383, P383L, P383M, P383V, P383N, P383C, P383Q, P383S or P383T;
    an amino acid substitution at position 10 of SEQ ID NO: 1 with the substitution being V10R or V10H;
    an amino acid substitution at position 114 of SEQ ID NO: 1 with the substitution being L114A, L114G, L114I, L114M, L114P or L114V;
    an amino acid substitution at position 118 of SEQ ID NO: 1 with the substitution being I118A, I118G, I118L, I118M, I118P or I118V;
    an amino acid substitution at position 192 of SEQ ID NO: 1 with the substitution being S92A, S192G, S192I, S192L, S192M, S192P or S192V;
    an amino acid substitution at position 197 of SEQ ID NO: 1 with the substitution being S97A, S197G, S197I, S197L, S197M, S197P or S197V;
    an amino acid substitution at position 220 of SEQ ID NO: 1 with the substitution being Y220F or Y220W;
    an amino acid substitution at position 225 of SEQ ID NO: 1 with the substitution being N225A, N225G, N225I, N225L, N225M, N225P or N225V;
    an amino acid substitution at position 304 of SEQ ID NO: 1 with the substitution being A304G, A304I, A304L, A304M, A304P or A304V;

an amino acid substitution at position 306 of SEQ ID NO: 1 with the substitution being D306R, D306H or D306K;

an amino acid substitution at position 318 of SEQ ID NO: 1 with the substitution being P318R, P318H or P318K;

an amino acid substitution at position 323 of SEQ ID NO: 1 with the substitution being T323A, T323G, T323I, T323L, T323M, T323P, or T323V;

an amino acid substitution at position 339 of SEQ ID NO: 1 with the substitution being L339A, L339G, L339I, L339M, L339P or L339V;

an amino acid substitution at position 349 of SEQ ID NO: 1 with the substitution being F349W or F349Y;

an amino acid substitution at position 357 of SEQ ID NO: 1 with the substitution being G357A, G357I, G357L, G357M, G357P or G357V;

an amino acid substitution at position 459 of SEQ ID NO: 1 with the substitution being A459N, A459C, A459Q or A459S, A459T;

an amino acid substitution at position 476 of SEQ ID NO: 1 with the substitution being Q476A, Q476G, Q476I, Q476L, Q476M, Q476P or Q476V;

an amino acid substitution at position 481 of SEQ ID NO: 1 with the substitution being E481A, E481G, E481, E481L, E481M, E481P or E481V;

an amino acid substitution at position 484 of SEQ ID NO: 1 with the substitution being A484N, A484C, A484Q, A484S or A484T;

an amino acid substitution at position 487 of SEQ ID NO: 1 with the substitution being Q487A, Q487G, Q487I, Q487L, Q487M, Q487P or Q487V;

an amino acid substitution at position 488 of SEQ ID NO: 1 with the substitution being K488A, K488G, K488I, K488L, K488M, K488P or K488V;

an amino acid substitution at position 506 of SEQ ID NO: 1 with the substitution being A506N, A506C, A506Q, A506S or A506T;

an amino acid substitution at position A511 of SEQ ID NO: 1 with the substitution being A511N, A511C, A511Q, A511S or A511T;

an amino acid substitution at position 526 of SEQ ID NO: 1 with the substitution being R526D or R526E;

an amino acid substitution at position 530 of SEQ ID NO: 1 with the substitution being E530A, E530G, E530, E530L, E530M, E530P, or E530V;

an amino acid substitution at position 532 of SEQ ID NO: 1 with the substitution being G532R, G532H or G532K;

an amino acid substitution at position 533 of SEQ ID NO: 1 with the substitution being D533A, D533G, D533, D533L, D533M, D533P or D533V;

an amino acid substitution at position 537 of SEQ ID NO: 1 with the substitution being D537A, D537G, D537, D537L, D537M, D537P or D537V;

an amino acid substitution at position 550 of SEQ ID NO: 1 with the substitution being V550A, V550G, V550I, V550L, V550M or, V550P;

an amino acid substitution at position 556 of SEQ ID NO: 1 with the substitution being S556N, S556C, S556Q or S556T;

an amino acid substitution at position 564 of SEQ ID NO: 1 with the substitution being T564D or T564E;

an amino acid substitution at position 590 of SEQ ID NO: 1 with the substitution being D590N, D590C, D590Q, D590S, D590T, D590A, D590G, D590I, D590L, D590M, D590P or D590V;

an amino acid substitution at position 649 of SEQ ID NO: 1 with the substitution being A649D or A649E;

an amino acid substitution at position 667 of SEQ ID NO: 1 with the substitution being R667D, R667E, R667R, R667H or R667K;

an amino acid substitution at position 703 of SEQ ID NO: 1 with the substitution being A703D or A703E; and an amino acid substitution at position 705 of SEQ ID NO: 1 with the substitution being K705N, K705C, K705Q, K705S or K705T.

11. The trehalose phosphorylase of claim 1, wherein the amino acid sequence of the trehalose phosphorylase comprises
(a) an amino acid substitution at the three amino acid positions 383, 556, and 590 of SEQ ID NO: 1;
(b) an amino acid substitution at the four amino acid positions 712, 383, 114 and 118 of SEQ ID NO: 1; and/or 383, 487, 556, and 590 of SEQ ID NO: 1; and/or 383, 225, 556, and 590 of SEQ ID NO: 1;
(c) an amino acid substitution at the five amino acid positions 712, 383, 114, 1118 and 304 of SEQ ID NO: 1; and/or 712, 383, 114, 118 and 357 of SEQ ID NO: 1; and/or 383, 225, 304, 556, and 590 of SEQ ID NO: 1; and/or 383, 225, 487, 556, and 590 of SEQ ID NO: 1; or
(d) an amino acid substitution at the six amino acid positions 712, 383, 114, 118, 304 and 357 of SEQ ID NO: 1; and/or 383, 225, 304, 487, 556, and 590 of SEQ ID NO: 1.

12. The trehalose phosphorylase of claim 1, wherein the identity of the amino acid sequence of the trehalose phosphorylase with the amino acid sequence of SEQ ID NO: 1 is at least 81%.

13. The trehalose phosphorylase of claim 1, wherein the amino acid sequence of the trehalose phosphorylase comprises or consists of any one of amino acid sequences of SEQ ID NO: 2, 3, 4, 5, 6, 7, 8, 9, 10, 11, 12, 13, 14, 15, 16, 17, 18, 19, 20, 21, 22, 23,24,25,26,27,28,29,30,31,32,33,34, 35,36,37,38,39,40,41,42,43,44,45,46,47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 87, 88, 89, 91, 93, 94, 95, 97, 98, 101, 103, 104, 105, 107, 109, 110, 111, 113, 114, 115, 117, 119, 121, 123, 125, 128, 130, 131, 132, 133, 134, 135, 136, 137, 138, 139, 140, 141, 146, 147, 149, 150, 151, 152, 154, 155, 156, 157, 158, 159, or 190.

14. The trehalose phosphorylase of claim 1, wherein the trehalose phosphorylase is capable of catalyzing conversion of
glucose and alpha-D-glucose-1 phosphate to trehalose and inorganic phosphate
and/or
conversion of trehalose and inorganic phosphate to glucose and alpha-D-glucose-1 phosphate.

15. The trehalose phosphorylase of claim 1, wherein the trehalose phosphorylase, has at least one of characteristics (A), (B), (C), (D) and (E), or any combination thereof, wherein
characteristic (A) is thermal stability after incubation at 52° C. for 15 minutes defined by a residual activity of from 30% to 100%;
characteristic (B) is thermal stability after incubation at 52° C. for 15 minutes which is characterized by
i) a Tm30-value of at least 52° C., and/or
ii) a Tm50-value of at least 52° C.;
characteristic (C) is thermal stability characterized by
i) a Tm30-value between 52° C. and 90° C. and/or
ii) a Tm50-value between 52° C. and 90° C.; and characteristic (D) is thermal stability characterized by
i) a process stability characterized by a half-life at 45° C. of from 3 hours to 9 days or more; or
ii) a process stability characterized by a half-life at 45° C. of from 24 hours to 9 days or more, or
iii) a process stability characterized by a half-life at 45° C. of 4 days to 9 days or more; and
characteristic (E) is relative activity expressed as 100/500-ratio of between 0.65 and 1.0, wherein
the 100/500-ratio is defined as the ratio of
[trehalose activity at 100 mM glucose and 100 mM alpha-glucose-1 phosphate]/[trehalose activity at 500 mM glucose and 100 mM alpha-glucose-1 phosphate].

16. A trehalose phosphorylase of claim 1, wherein the trehalose phosphorylase retains at least 30% of its initial activity after incubation for 15 minutes at 52° C. in a buffer containing 1 M sucrose, wherein the initial activity is determined after incubation for 15 minutes at room temperature and/or wherein the trehalose phosphorylase retains at least 50% of its initial activity after incubation for 15 minutes at 52° C. in a buffer containing 1 M sucrose, wherein the initial activity is determined after incubation for 15 minutes at room temperature.

17. A trehalose phosphorylase of claim 1, wherein the trehalose phosphorylase is derived from *Schizophyllum commune* and has a residual activity of at least 30% after incubation at 52° C. for 15 minutes, in a buffer containing 1 M sucrose, wherein the initial activity is determined after incubation for 15 minutes at room temperature.

18. A trehalose phosphorylase of claim 1, wherein the trehalose phosphorylase comprises an amino acid sequence of SEQ ID NO: 1, wherein the trehalose phosphorylase has a residual activity of at least 30% after incubation at 52° C. for 15 minutes, in a buffer containing 1 M sucrose, wherein the initial activity is determined after incubation for 15 minutes at room temperature.

19. A method for reacting a glucosyl monosaccharide and alpha-D-glucose-1 phosphate, wherein the method comprises reacting the glucosyl monosaccharide and alpha-D-glucose-1 phosphate with a trehalose phosphorylase as defined in claim 1.

20. A method for preparing trehalose comprising reacting glucose and alpha-D-glucose-1 phosphate at a temperature of at least 40° C. in the presence of a trehalose phosphorylase, wherein the trehalose phosphorylase
(i) retains at least 30% of its activity after incubation for 15 minutes at 52° C. in a buffer containing 1 M sucrose compared to its activity without thermal treatment; and/or
(ii) retains at least 50% of its activity after incubation for 15 minutes at 52° C. in a buffer containing 1 M sucrose compared to its activity without thermal treatment; and/or
(iii) has a ratio of activity at 100 mM glucose to activity at 500 mM glucose of at least 0.65, wherein the amino acid sequence of the trehalose phosphorylase is at least 80% identical to and/or at least 80% homologous to an amino acid sequence of SEQ ID NO: 1, wherein the amino acid sequence of the trehalose phosphorylase comprises an amino acid substitution at one or more amino acid positions, wherein
(a) the one or more amino acid positions is/are selected from the group consisting of amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1,
(b) when the amino acid substitution comprises a substitution at amino acid position 649, then the amino acid substitution at position 649 is selected from the group consisting of the substitutions 649D and 649E, and
(c) when the amino acid substitution comprises a substitution at amino acid position 10, then the amino acid substitution at position 10 is selected from the group consisting of the substitutions V10R and V10H.

21. A method for increasing thermal stability of a trehalose phosphorylase, wherein the method comprises:
aligning an amino acid sequence of a first trehalose phosphorylase with an amino acid sequence of a second trehalose phosphorylase,
identifying one or more amino acid positions of the amino acid sequence of the second trehalose phosphorylase which correspond to one or more amino acid positions of the amino acid sequence of the first trehalose phosphorylase, wherein substitution of an amino acid residue at the one or more amino acid position of the amino acid sequence of the first trehalose phosphorylase increases thermal stability of the first trehalose phosphorylase,
substituting an amino acid residue at the one or more amino acid positions of the second trehalose phosphorylase corresponding to the one or more amino acid positions of the amino acid sequence of the first trehalose phosphorylase, wherein substitution of an amino acid residue at the one or more amino acid position of the amino acid sequence of the first trehalose phosphorylase increases thermal stability of the first trehalose phosphorylase,
wherein the first trehalose phosphorylase is a trehalose phosphorylase comprising an amino acid sequence according to SEQ ID NO: 1,
wherein the substitution of an amino acid residue in the second trehalose phosphorylase is performed at one or more of the amino acids positions corresponding to amino acid positions 712, 383, 10, 114, 118, 192, 197, 220, 225, 304, 306, 318, 323, 339, 349, 357, 459, 476, 481, 484, 487, 488, 506, 511, 526, 530, 532, 533, 537, 550, 556, 564, 590, 649, 667, 703 and 705 of SEQ ID NO: 1, wherein
(a) when the amino acid substitution comprises a substitution at amino acid position 649, then the amino acid substitution at position 649 is selected from the group consisting of the substitutions 649D and 649E, and
(b) when the amino acid substitution comprises a substitution at amino acid position 10, then the amino acid substitution at position 10 is selected from the group consisting of the substitutions V10R and V10H.

22. The trehalose phosphorylase of claim 11, wherein the trehalose phosphorylase, has at least one of characteristics (A), (B), (C), (D) and (E), or any combination thereof, wherein
characteristic (A) is thermal stability after incubation at 52° C. for 15 minutes defined by a residual activity of from 30% to 100%;
characteristic (B) is thermal stability after incubation at 52° C. for 15 minutes which is characterized by
ii) a Tm30-value of at least 52° C., and/or
ii) a Tm50-value of at least 52° C.;
characteristic (C) is thermal stability characterized by
i) a Tm30-value between 52° C. and 90° C. and/or
ii) a Tm50-value between 52° C. and 90° C.; and
characteristic (D) is thermal stability characterized by
i) a process stability characterized by a half-life at 45° C. of from 3 hours to 9 days or more; or ii) a process stability characterized by a half-life at 45° C. of from 24 hours to 9 days or more, or iii) a process stability characterized by a half-life at 45° C. of 4 days to 9 days or more; and characteristic (E) is relative activity expressed as 100/500-ratio of between 0.65 and 1.0, wherein the 100/500-ratio is defined as the ratio of

[trehalose activity at 100 mM glucose and 100 mM alpha-glucose-1 phosphate]/[trehalose activity at 500 mM glucose and 100 mM alpha-glucose-1 phosphate].

23. The trehalose phosphorylase of claim 1, wherein the amino acid sequence has amino acid substitutions at positions 383 and 590.

* * * * *